US012134656B2

(12) United States Patent
Sato et al.

(10) Patent No.: US 12,134,656 B2
(45) Date of Patent: Nov. 5, 2024

(54) DICKKOPF-1 VARIANT ANTIBODIES AND METHODS OF USE

(71) Applicant: Twist Bioscience Corporation, South San Francisco, CA (US)

(72) Inventors: Aaron Sato, Burlingame, CA (US); Tom Yuan, San Francisco, CA (US); Linya Wang, Milpitas, CA (US); Fumiko Axelrod, Palo Alto, CA (US)

(73) Assignee: Twist Bioscience Corporation, South San Francisco, CA (US)

( * ) Notice: Subject to any disclaimer, the term of this patent is extended or adjusted under 35 U.S.C. 154(b) by 0 days.

(21) Appl. No.: 18/056,679

(22) Filed: Nov. 17, 2022

(65) Prior Publication Data

US 2023/0312749 A1    Oct. 5, 2023

Related U.S. Application Data

(60) Provisional application No. 63/379,634, filed on Oct. 14, 2022, provisional application No. 63/374,497, filed on Sep. 2, 2022, provisional application No. 63/286,522, filed on Dec. 6, 2021, provisional application No. 63/280,840, filed on Nov. 18, 2021.

(51) Int. Cl.
C07K 16/32 (2006.01)

(52) U.S. Cl.
CPC ........ *C07K 16/32* (2013.01); *C07K 2317/565* (2013.01); *C07K 2317/569* (2013.01); *C07K 2317/92* (2013.01)

(58) Field of Classification Search
CPC .............. C07K 16/32; C07K 2317/565; C07K 2317/569; C07K 2317/92
See application file for complete search history.

(56) References Cited

U.S. PATENT DOCUMENTS

| | | | |
|---|---|---|---|
| 9,228,010 B2 | 1/2016 | Li et al. | |
| 10,706,955 B2 | 7/2020 | Bremel et al. | |
| 2007/0231328 A1 | 10/2007 | Jardieu et al. | |
| 2009/0074793 A1 | 3/2009 | Martin et al. | |
| 2010/0167285 A1 | 7/2010 | Schreiber et al. | |
| 2013/0090457 A1 | 4/2013 | Cunningham et al. | |
| 2020/0325235 A1 | 10/2020 | Tabibiazar et al. | |
| 2021/0355194 A1 * | 11/2021 | Sato | C07K 16/005 |

FOREIGN PATENT DOCUMENTS

| | | | | |
|---|---|---|---|---|
| WO | WO-2010130832 A2 * | 11/2010 | | C07K 14/51 |
| WO | 2015081440 A1 | 6/2015 | | |
| WO | 2016022557 A1 | 2/2016 | | |
| WO | 2016126882 A1 | 8/2016 | | |
| WO | 2016126987 A1 | 8/2016 | | |
| WO | 2016172377 A1 | 10/2016 | | |
| WO | 2016183100 A1 | 11/2016 | | |
| WO | 2017049231 A1 | 3/2017 | | |
| WO | 2017053450 A1 | 3/2017 | | |
| WO | 2017095958 A1 | 6/2017 | | |
| WO | 2017214574 A1 | 12/2017 | | |
| WO | 2018026920 A1 | 2/2018 | | |
| WO | 2018038772 A1 | 3/2018 | | |
| WO | 2018057526 A2 | 3/2018 | | |
| WO | 2018094263 A1 | 5/2018 | | |
| WO | 2018112426 A1 | 6/2018 | | |
| WO | 2018156792 A1 | 8/2018 | | |
| WO | 2018170164 A1 | 9/2018 | | |
| WO | 2018170169 A1 | 9/2018 | | |
| WO | 2018231864 A1 | 12/2018 | | |
| WO | 2018231872 A1 | 12/2018 | | |
| WO | 2019051501 A1 | 3/2019 | | |
| WO | 2019079769 A1 | 4/2019 | | |
| WO | 2019084500 A1 | 5/2019 | | |
| WO | 2019136175 A1 | 7/2019 | | |
| WO | 2019222706 A1 | 11/2019 | | |
| WO | 2020139871 A1 | 7/2020 | | |
| WO | 2020176362 A1 | 9/2020 | | |
| WO | 2020176678 A1 | 9/2020 | | |
| WO | 2020176680 A1 | 9/2020 | | |
| WO | 2020257612 A1 | 12/2020 | | |
| WO | 2021061829 A1 | 4/2021 | | |
| WO | 2021061842 A1 | 4/2021 | | |
| WO | 2021119193 A2 | 6/2021 | | |
| WO | 2021222315 A2 | 11/2021 | | |

(Continued)

OTHER PUBLICATIONS

Fatima, A., et al., "Development of VHH Antibodies against Dengue Virus Type 2 NS1 and Comparison with Monoclonal Antibodies for Use in Immunological Diagnosis," PLoS One, vol. 9, issue 4, pp. 1-12 (2014).

International Search Report and Written Opinion issued for International Application No. PCT/US22/50322 on Aug. 30, 2023 (15 pages).

Tremblay, J.M., et al., "Camelid single domain antibodies (VHHs) as neuronal cell intrabody binding agents and inhibitors of Clostridium botulinum neurotoxin (BoNT) proteases," Toxicon, vol. 56, No. 6, pp. 990-998 (2010).

*Primary Examiner* — Brad Duffy
*Assistant Examiner* — Elizabeth A Shupe
(74) *Attorney, Agent, or Firm* — McNeill PLLC

(57) ABSTRACT

Provided herein are methods and compositions relating to libraries of optimized antibodies having nucleic acids encoding for an antibody comprising modified sequences. Libraries described herein comprise nucleic acids encoding Dickkopf WNT signaling pathway inhibitor 1 (DKK1) antibodies. Further described herein are protein libraries generated when the nucleic acid libraries are translated. Further described herein are cell libraries expressing variegated nucleic acid libraries described herein.

20 Claims, 117 Drawing Sheets

(4 of 117 Drawing Sheet(s) Filed in Color)

Specification includes a Sequence Listing.

(56) References Cited

FOREIGN PATENT DOCUMENTS

| | | |
|---|---|---|
| WO | 2021222316 A2 | 11/2021 |
| WO | 2022010934 A2 | 1/2022 |
| WO | 2022046797 A1 | 3/2022 |
| WO | 2022046944 A2 | 3/2022 |
| WO | 2022047076 A1 | 3/2022 |
| WO | 2022076326 A1 | 4/2022 |
| WO | 2022086866 A1 | 4/2022 |
| WO | 2022087293 A1 | 4/2022 |
| WO | 2022093811 A1 | 5/2022 |
| WO | 2022098662 A2 | 5/2022 |
| WO | 2022159620 A1 | 7/2022 |
| WO | 2022178137 A1 | 8/2022 |
| WO | 2022204301 A1 | 9/2022 |
| WO | 2022204309 A1 | 9/2022 |
| WO | 2022204316 A2 | 9/2022 |
| WO | 2022217004 A1 | 10/2022 |
| WO | 2022235579 A1 | 11/2022 |
| WO | 2022235584 A1 | 11/2022 |
| WO | 2022271884 A2 | 12/2022 |
| WO | 2023023183 A2 | 2/2023 |
| WO | 2023023190 A2 | 2/2023 |
| WO | 2023023285 A2 | 2/2023 |
| WO | 2023069367 A1 | 4/2023 |
| WO | 2023076419 A2 | 5/2023 |
| WO | 2023076420 A2 | 5/2023 |
| WO | 2023076687 A1 | 5/2023 |
| WO | 2023091609 A2 | 5/2023 |
| WO | 2023091614 A2 | 5/2023 |
| WO | 2023102034 A2 | 6/2023 |
| WO | 2023114432 A2 | 6/2023 |
| WO | 2023130123 A2 | 7/2023 |
| WO | 2023154533 A2 | 8/2023 |
| WO | 2023172520 A2 | 9/2023 |
| WO | 2023191858 A2 | 10/2023 |
| WO | 2023192635 A2 | 10/2023 |
| WO | 2023196499 A1 | 10/2023 |
| WO | 2023205345 A2 | 10/2023 |

\* cited by examiner

| Bins | ID | DKK1-24 | DKK1-825 | DKK1-28 | DKN-01 | DKK1-37 | DKK1-109 | DKK1-93 | DKK1-100 | DKK1-245 | DKK1-99 | DKK1-103 | DKK1-10 | DKK1-243 |
|---|---|---|---|---|---|---|---|---|---|---|---|---|---|---|
| Bins | | 1 | 1 | 1 | 1 | 2 | 2 | 2 | 2 | 2 | 2 | 2 | 2 | 2 |
| 1 | DKK1-24 | | | | | | | | | | | | | |
| 1 | DKK1-825 | | | | | | | | | | | | | |
| 1 | DKK1-28 | | | | | | | | | | | | | |
| 1 | DKN-01 | | | | | | | | | | | | | |
| 2 | DKK1-37 | | | | | | | | | | | | | |
| 2 | DKK1-109 | | | | | | | | | | | | | |
| 2 | DKK1-93 | | | | | | | | | | | | | |
| 2 | DKK1-100 | | | | | | | | | | | | | |
| 2 | DKK1-245 | | | | | | | | | | | | | |
| 2 | DKK1-99 | | | | | | | | | | | | | |
| 2 | DKK1-103 | | | | | | | | | | | | | |
| 2 | DKK1-10 | | | | | | | | | | | | | |
| 2 | DKK1-243 | | | | | | | | | | | | | |

*FIG. 17A*

| Name | DKK1 CRD1 $K_D$ (M) | DKK1 CRD2 $K_D$ (M) | DKK1 $K_D$ (M) |
|---|---|---|---|
| DKK1-99 IgG2 | 5.22E-06 | N/A | 2.49E-07 |
| DKK1-103 IgG2 | 3.71E-09 | N/A | 7.35E-08 |
| DKK1-109 IgG2 | 9.29E-09 | N/A | 4.46E-08 |
| DKK1-100 IgG2 | N/A | 2.08E-10 | 7.73E-10 |
| Positive Control | N/A | 7.91E-10 | 9.77E-10 |
| DKK1-805 | N/A | 3.25E-09 | 5.22E-08 |
| DKK1-820 | N/A | 7.54E-09 | 8.74E-09 |
| DKK1-821 | N/A | N/A | 3.65E-08 |
| DKK1-824 | 5.59E-09 | 1.45E-05 | 5.58E-08 |
| DKK1-825 | N/A | 6.90E-10 | 6.36E-11 |
| DKK1-830 | N/A | 1.69E-10 | 3.27E-11 |
| DKK1-831 | 2.49E-08 | N/A | 1.09E-07 |
| DKK1-837 | 2.26E-08 | N/A | 4.21E-08 |
| DKK1-839 | N/A | 1.68E-11 | 4.94E-12 |
| DKK1-739 | N/A | 4.43E-11 | 1.57E-09 |
| DKK1-744 | N/A | 1.49E-09 | 3.14E-11 |
| DKK1-448 | N/A | 2.57E-09 | 8.23E-08 |
| DKK1-449 | 9.22E-08 | N/A | 1.41E-07 |
| DKK1-473 | N/A | 1.09E-09 | 1.61E-09 |
| DKK1-477 | N/A | 2.77E-10 | 1.73E-09 |
| DKK1-478 | N/A | 7.08E-09 | 2.75E-09 |
| DKK1-481 | N/A | N/A | 1.12E-08 |
| DKK1-485 | 2.79E-09 | N/A | 1.56E-08 |

*FIG. 17C*

DICKKOPF-1 VARIANT ANTIBODIES AND METHODS OF USE

CROSS REFERENCE

This application claims the benefit of U.S. Provisional Patent Application No. 63/280,840, filed on Nov. 18, 2021, U.S. Provisional Patent Application No. 63/286,522, filed on Dec. 6, 2021, U.S. Provisional Patent Application No. 63/374,497, filed on Sep. 2, 2022, and U.S. Provisional Patent Application No. 63/379,634, filed on Oct. 14, 2022, which is each incorporated by reference in its entirety.

SEQUENCE LISTING

The instant application contains a Sequence Listing which has been submitted electronically in XML format and is hereby incorporated by reference in its entirety. Said XML copy, created on Apr. 17, 2023, is named 44854-843_201_SL.xml and is 2,407,906 bytes in size.

BACKGROUND

Dickkopf WNT signaling pathway inhibitor 1 (also known as dickkopf-1 or DKK1) is a secreted glycoprotein characterized by two cysteine-rich domains that mediate protein-protein interactions. DKK1 is involved in embryonic development of the heart, head, and forelimbs through its inhibition of the WNT signaling pathway. In adults, elevated expression of this gene has been observed in numerous human cancers, and this protein may promote proliferation, invasion, and growth in cancer cell lines. Given the role of DKK1 in various diseases and disorders, there is a need for improved therapeutics.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF SUMMARY

Provided herein are antibodies or antibody fragments comprising a variable domain, heavy chain region (VH), wherein the VH comprises complementarity determining regions CDRH1, CDRH2, and CDRH3, and wherein (a) an amino acid sequence of CDRH1 is as set forth in any one of SEQ ID NOs: 1-98 or 919-1332; (b) an amino acid sequence of CDRH2 is as set forth in any one of SEQ ID NOs: 99-196 or 1333-1746; and (c) an amino acid sequence of CDRH3 is as set forth in any one of SEQ ID NOs: 197-294 or 1747-2160. Further provided herein are antibodies or antibody fragments, wherein the antibody is a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv), a single chain antibody, a Fab fragment, a F(ab')2 fragment, a Fd fragment, a Fv fragment, a single-domain antibody, an isolated complementarity determining region (CDR), a diabody, a fragment comprised of only a single monomeric variable domain, disulfide-linked Fvs (sdFv), an intrabody, an anti-idiotypic (anti-Id) antibody, or ab antigen-binding fragments thereof. Further provided herein are antibodies or antibody fragments, wherein the antibody is a single domain antibody. Further provided herein are antibodies or antibody fragments, wherein the antibody or antibody fragment. Further provided herein are antibodies or antibody fragments, wherein the antibody or antibody fragment comprises a $K_D$ of less than 50 nM. Further provided herein are antibodies or antibody fragments, wherein the antibody or antibody fragment comprises a $K_D$ of less than 25 nM. Further provided herein are antibodies or antibody fragments, wherein the antibody or antibody fragment comprises a $K_D$ of less than 10 nM. Further provided herein are antibodies or antibody fragments, wherein the antibody or antibody fragment comprises a $K_D$ of less than 5 nM. Further provided herein are antibodies or antibody fragments, wherein the antibody or antibody fragment binds to DKK1.

Provided herein are antibodies or antibody fragments comprising a variable domain, heavy chain region (VH) comprising an amino acid sequence at least about 90% identical to a sequence as set forth in any one of SEQ ID NOs: 295-392, 394-712, or 2164-2258, and wherein the VL comprises at least 90% sequence identity to any one of SEQ ID NOs 713-918. Further provided herein are antibodies or antibody fragments, wherein the antibody or antibody fragment binds to a spike glycoprotein. Further provided herein are antibodies or antibody fragments, wherein the antibody or antibody fragment binds to a receptor binding domain of the spike glycoprotein. Further provided herein are antibodies or antibody fragments, wherein the antibody or antibody fragment comprises a $K_D$ of less than 50 nM. Further provided herein are antibodies or antibody fragments, wherein the antibody or antibody fragment comprises a $K_D$ of less than 25 nM. Further provided herein are antibodies or antibody fragments, wherein the antibody or antibody fragment comprises a $K_D$ of less than 10 nM. Further provided herein are antibodies or antibody fragments, wherein the antibody or antibody fragment comprises a $K_D$ of less than 5 nM. Further provided herein are antibodies or antibody fragments, wherein the antibody is a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv), a single chain antibody, a Fab fragment, a F(ab')2 fragment, a Fd fragment, a Fv fragment, a single-domain antibody, an isolated complementarity determining region (CDR), a diabody, a fragment comprised of only a single monomeric variable domain, disulfide-linked Fvs (sdFv), an intrabody, an anti-idiotypic (anti-Id) antibody, or ab antigen-binding fragments thereof. Further provided herein are antibodies or antibody fragments, wherein the antibody is a single domain antibody.

Provided herein are nucleic acid compositions comprising: a first nucleic acid encoding a variable domain, heavy chain region (VH) comprising complementarity determining regions CDRH1, CDRH2, and CDRH3, and wherein (a) an amino acid sequence of CDRH1 is as set forth in any one of SEQ ID NOs: 1-98 or 919-1332; (b) an amino acid sequence of CDRH2 is as set forth in any one of SEQ ID NOs: 99-196 or 1333-1746; and (c) an amino acid sequence of CDRH3 is as set forth in any one of SEQ ID NOs: 197-294 or 1747-2160; and an excipient.

Provided herein are nucleic acid compositions comprising: a) a first nucleic acid encoding a variable domain, heavy chain region (VH) comprising an amino acid sequence at least about 90% identical to a sequence as set forth in any one of SEQ ID NOs: 295-392, 394-712, or 2164-2258; and an excipient.

Provided herein are antibodies or antibody fragments comprising a variable domain, light chain region (VL), wherein the VL comprises complementarity determining regions CDRL1, CDRL2, and CDRL3, and wherein (a) an amino acid sequence of CDRL1 is as set forth in any one of SEQ ID NOs: 2259-2464; (b) an amino acid sequence of CDRL2 is as set forth in any one of SEQ ID NOs: 2465-2521; and (c) an amino acid sequence of CDRL3 is as set forth in any one of SEQ ID NOs: 2522-2727. Further provided herein are antibodies or antibody fragments, wherein the antibody is a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv), a single chain antibody, a Fab fragment, a F(ab')2 fragment, a Fd fragment, a Fv fragment, a single-domain antibody, an isolated complementarity determining region (CDR), a diabody, a fragment comprised of only a single monomeric variable domain, disulfide-linked Fvs (sdFv), an intrabody, an anti-idiotypic (anti-Id) antibody, or ab antigen-binding fragments thereof. Further provided herein are antibodies or antibody fragments, wherein the antibody is a single domain antibody. Further provided herein are antibodies or antibody fragments, wherein the antibody or antibody fragment. Further provided herein are antibodies or antibody fragments, wherein the antibody or antibody fragment comprises a $K_D$ of less than 50 nM. Further provided herein are antibodies or antibody fragments, wherein the antibody or antibody fragment comprises a $K_D$ of less than 25 nM. Further provided herein are antibodies or antibody fragments, wherein the antibody or antibody fragment comprises a $K_D$ of less than 10 nM. Further provided herein are antibodies or antibody fragments, wherein the antibody or antibody fragment comprises a $K_D$ of less than 5 nM. Further provided herein are antibodies or antibody fragments, wherein the antibody or antibody fragment binds to DKK1.

Provided herein are antibodies or antibody fragments comprising a variable domain, light chain region (VL) comprising an amino acid sequence at least about 90% identical to a sequence as set forth in any one of SEQ ID NOs: 713-918. Further provided herein are antibodies or antibody fragments, wherein the antibody or antibody fragment binds to a spike glycoprotein. Further provided herein are antibodies or antibody fragments, wherein the antibody or antibody fragment binds to a receptor binding domain of the spike glycoprotein. Further provided herein are antibodies or antibody fragments, wherein the antibody or antibody fragment comprises a $K_D$ of less than 50 nM. Further provided herein are antibodies or antibody fragments, wherein the antibody or antibody fragment comprises a $K_D$ of less than 25 nM. Further provided herein are antibodies or antibody fragments, wherein the antibody or antibody fragment comprises a $K_D$ of less than 10 nM. Further provided herein are antibodies or antibody fragments, wherein the antibody or antibody fragment comprises a $K_D$ of less than 5 nM. Further provided herein are antibodies or antibody fragments, wherein the antibody is a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv), a single chain antibody, a Fab fragment, a F(ab')2 fragment, a Fd fragment, a Fv fragment, a single-domain antibody, an isolated complementarity determining region (CDR), a diabody, a fragment comprised of only a single monomeric variable domain, disulfide-linked Fvs (sdFv), an intrabody, an anti-idiotypic (anti-Id) antibody, or ab antigen-binding fragments thereof. Further provided herein are antibodies or antibody fragments, wherein the antibody is a single domain antibody.

Provided herein are nucleic acid compositions comprising: a first nucleic acid encoding a variable domain, light chain region (VL) comprising complementarily determining regions CDRL1, CDRL2, and CDRL3, and wherein (a) an amino acid sequence of CDRL1 is as set forth in any one of SEQ ID NOs: 2259-2464; (b) an amino acid sequence of CDRL2 is as set forth in any one of SEQ ID NOs: 2465-2521; and (c) an amino acid sequence of CDRL3 is as set forth in any one of SEQ ID NOs: 2522-2727; and an excipient.

Provided herein are nucleic acid compositions comprising: a) a first nucleic acid encoding a variable domain, light chain region (VL) comprising an amino acid sequence at least about 90% identical to a sequence as set forth in any one of SEQ ID NOs: 713-918; and an excipient.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 14A depicts an immune cell activation assay using peripheral blood mononuclear cells (PBMCs) and interferon gamma (IFN or IFN-γ). FIG. 14B depicts an immune cell activation assay using PBMCs and granulocyte-macrophage colony-stimulating factor (GM-CSF). GM-CSF is the marker for NK cell activation. Human PBMC is treated with immune stimulator, mWnt3a, hDKK1, and Dkk1 leads from ML synthetic library (FIG. 14C) and ML from VHH library (FIG. 14D). Cytokine release of GM-CSF is measured by ELISA.

FIGS. 17A-C show anti-DKK1 binding to hDKK1 by SPR analysis. FIG. 17A shows two epitope binds (activation of Wnt signaling vs immune response) apparent among DKK1 leads. FIG. 17B shows an example of a hDDK1 protein with CRD1 and CRD2 annotated. FIG. 17C shows that DKK1 leads which bind to hDKK1 CRD1 and/or hDKK1 CRD2 result in different activation pathways.

FIG. 19D shows another graph of immune response activation.

FIG. 20A shows a schematic of mice inoculation with PC3 cells. Dosing was initiated at tumor volume average of approximately 100 mm$^3$ with 10 mg/kg via intraperitoneal injection once every 3 days for 8 cycles. Tumor sizes were measured 3 times a week. FIG. 20B shows that anti-DKK1 treatment downregulates tumor growth, showing its efficacy in tumor suppression. FIG. 20C shows that anti-DKK1 treatment downregulates tumor growth, showing efficacy in tumor suppression in days 1-7 of the study. FIG. 20D shows the mean tumor volume across days 1-7 of the study.

FIG. 22A shows a control DKN-01 antibody. FIG. 22B shows the results for DKK1-28. FIG. 22C shows the results for DKK1-100.

FIG. 26A shows results using the IFN-gamma marker of immune cell activation. FIG. 26B shows results using the GM-CSF marker for immune cell activation.

DETAILED DESCRIPTION

Figure 1A:
FIG. 1A depicts a first schematic of an immunoglobulin.
Figure 1B:
FIG. 1B depicts a second schematic of an immunoglobulin.
Figure 2:
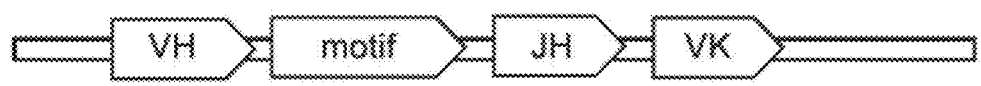
FIG. 2 depicts a schematic of a motif for placement in an immunoglobulin.
Figure 2:
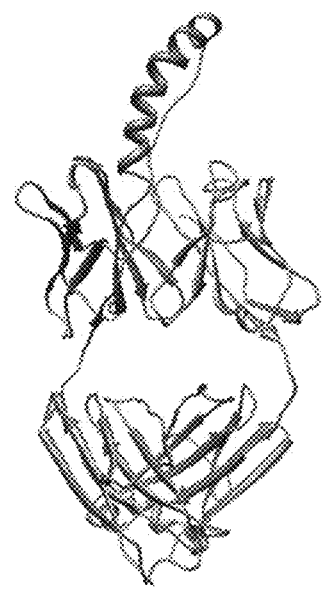

The present disclosure employs, unless otherwise indicated, conventional molecular biology techniques, which are within the skill of the art. Unless defined otherwise, all technical and scientific terms used herein have the same meaning as is commonly understood by one of ordinary skill in the art.

Definitions

Throughout this disclosure, various embodiments are presented in a range format. It should be understood that the description in range format is merely for convenience and brevity and should not be construed as an inflexible limitation on the scope of any embodiments. Accordingly, the description of a range should be considered to have specifically disclosed all the possible subranges as well as individual numerical values within that range to the tenth of the unit of the lower limit unless the context clearly dictates otherwise. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual values within that range, for example, 1.1, 2, 2.3, 5, and 5.9. This applies regardless of the breadth of the range. The upper and lower limits of these intervening ranges may independently be included in the smaller ranges, and are also encompassed within the disclosure, subject to any specifically excluded limit in the stated range. Where the stated range includes one or both of the limits, ranges excluding either or both of those included limits are also included in the disclosure, unless the context clearly dictates otherwise.

The terminology used herein is for the purpose of describing particular embodiments only and is not intended to be limiting of any embodiment. As used herein, the singular forms "a," "an" and "the" are intended to include the plural forms as well, unless the context clearly indicates otherwise. It will be further understood that the terms "comprises" and/or "comprising," when used in this specification, specify the presence of stated features, integers, steps, operations, elements, components, and/or groups, but do not preclude the presence or addition of one or more other features, integers, steps, operations, elements, components, and/or groups thereof. As used herein, the term "and/or" includes any and all combinations of one or more of the associated listed items.

Unless specifically stated or obvious from context, as used herein, the term "about" in reference to a number or range of numbers is understood to mean the stated number and numbers +/−10% thereof, or 10% below the lower listed limit and 10% above the higher listed limit for the values listed for a range.

Unless specifically stated, as used herein, the term "nucleic acid" encompasses double- or triple-stranded nucleic acids, as well as single-stranded molecules. In double- or triple-stranded nucleic acids, the nucleic acid strands need not be coextensive (i.e., a double-stranded nucleic acid need not be double-stranded along the entire length of both strands). Nucleic acid sequences, when provided, are listed in the 5' to 3' direction, unless stated otherwise. Methods described herein provide for the generation of isolated nucleic acids. Methods described herein additionally provide for the generation of isolated and purified nucleic acids. A "nucleic acid" as referred to herein can comprise at least 5, 10, 20, 30, 40, 50, 60, 70, 80, 90, 100, 125, 150, 175, 200, 225, 250, 275, 300, 325, 350, 375, 400, 425, 450, 475, 500, 600, 700, 800, 900, 1000, 1100, 1200, 1300, 1400, 1500, 1600, 1700, 1800, 1900, 2000, or more bases in length. Moreover, provided herein are methods for the synthesis of any number of polypeptide-segments encoding nucleotide sequences, including sequences encoding non-ribosomal peptides (NRPs), sequences encoding non-ribosomal peptide-synthetase (NRPS) modules and synthetic variants, polypeptide segments of other modular proteins, such as antibodies, polypeptide segments from other protein families, including non-coding DNA or RNA, such as regulatory sequences e.g. promoters, transcription factors, enhancers, siRNA, shRNA, RNAi, miRNA, small nucleolar RNA derived from microRNA, or any functional or structural DNA or RNA unit of interest. The following are non-limiting examples of polynucleotides: coding or non-coding regions of a gene or gene fragment, intergenic DNA, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), small nucleolar RNA, ribozymes, complementary DNA (cDNA), which is a DNA representation of mRNA, usually obtained by reverse transcription of messenger RNA (mRNA) or by amplification; DNA molecules produced synthetically or by amplification, genomic DNA, recombinant polynucleotides, branched polynucleotides, plasmids, vectors, isolated DNA of any sequence, isolated RNA of any sequence, nucleic acid probes, and primers. cDNA encoding for a gene or gene fragment referred herein may comprise at least one region encoding for exon sequences without an intervening intron sequence in the genomic equivalent sequence.

DKK1 Libraries

Provided herein are methods and compositions relating to dickkopf WNT signaling pathway inhibitor 1 (DKK1) variant immunoglobulins (e.g., antibody, VHH)comprising nucleic acids encoding for an immunoglobulin comprising a DKK1 binding domain. Immunoglobulins as described herein can stably support a DKK1 binding domain. Libraries as described herein may be further variegated to provide for variant libraries comprising nucleic acids each encoding for a predetermined variant of at least one predetermined reference nucleic acid sequence. Further described herein are protein libraries that may be generated when the nucleic acid libraries are translated. In some instances, nucleic acid libraries as described herein are transferred into cells to generate a cell library. Also provided herein are downstream applications for the libraries synthesized using methods described herein. Downstream applications include identification of variant nucleic acids or protein sequences with enhanced biologically relevant functions, e.g., improved stability, affinity, binding, functional activity, and for the treatment or prevention of a disease state associated with DKK1.

Provided herein are libraries comprising nucleic acids encoding for an immunoglobulin. In some instances, the immunoglobulin is an antibody. As used herein, the term antibody will be understood to include proteins having the characteristic two-armed, Y-shape of a typical antibody molecule as well as one or more fragments of an antibody that retain the ability to specifically bind to an antigen. Exemplary antibodies include, but are not limited to, a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv) (including fragments in which the VL and VH are joined using recombinant methods by a synthetic or natural linker that enables them to be made as a single protein chain in which the VL and VH regions pair to form monovalent molecules, including single chain Fab and scFab), a single chain antibody, a Fab fragment (including monovalent fragments comprising the VL, VH, CL, and CH1 domains), a F(ab')2 fragment (including bivalent fragments comprising two Fab fragments linked by a disulfide bridge at the hinge region), a Fd fragment (including fragments comprising the VH and CH1 fragment), a Fv fragment (including fragments comprising the VL and VH domains of a single arm of an antibody), a single-domain antibody (dAb or sdAb) (including fragments comprising a VH domain), an isolated complementarity determining region (CDR), a diabody (including fragments comprising bivalent dimers such as two VL and VH domains bound to each other and recognizing two different antigens), a fragment comprised of only a single monomeric variable domain, disulfide-linked Fvs (sdFv), an intrabody, an anti-idiotypic (anti-Id) antibody, or ab antigen-binding fragments thereof. In some instances, the libraries disclosed herein comprise nucleic acids encoding for an immunoglobulin, wherein the immunoglobulin is a Fv antibody, including Fv antibodies comprised of the minimum antibody fragment which contains a complete antigen-recognition and antigen-binding site. In some embodiments, the Fv antibody consists of a dimer of one heavy chain and one light chain variable domain in tight, non-covalent association, and the three hypervariable regions of each variable domain interact to define an antigen-binding site on the surface of the VH-VL dimer. In some embodiments, the six hypervariable regions confer antigen-binding specificity to the antibody. In some embodiments, a single variable domain (or half of an Fv comprising only three hypervariable regions specific for an antigen, including single domain antibodies isolated from camelid animals comprising one heavy chain variable domain such as VHH antibodies or nanobodies) has the ability to recognize and bind antigen. In some instances, the libraries disclosed herein comprise nucleic acids encoding for an immunoglobulin, wherein the immunoglobulin is a single-chain Fv or scFv, including antibody fragments comprising a VH, a VL, or both a VH and VL domain, wherein both domains are present in a single polypeptide chain. In some embodiments, the Fv polypeptide further comprises a polypeptide linker between the VH and VL domains allowing the scFv to form the desired structure for antigen binding. In some instances, a scFv is linked to the Fc fragment or a VHH is linked to the Fc fragment (including minibodies). In some instances, the antibody comprises immunoglobulin molecules and immunologically active fragments of immunoglobulin molecules, e.g., molecules that contain an antigen binding site. Immunoglobulin molecules are of any type (e.g., IgG, IgE, IgM, IgD, IgA and IgY), class (e.g., IgG 1, IgG 2, IgG 3, IgG 4, IgA 1 and IgA 2), or subclass.

In some embodiments, libraries comprise immunoglobulins that are adapted to the species of an intended therapeutic target. Generally, these methods include "mammalization" and comprise methods for transferring donor antigen-binding information to a less immunogenic mammal antibody acceptor to generate useful therapeutic treatments. In some instances, the mammal is mouse, rat, equine, sheep, cow, primate (e.g., chimpanzee, baboon, gorilla, orangutan, monkey), dog, cat, pig, donkey, rabbit, or human. In some instances, provided herein are libraries and methods for felinization and caninization of antibodies.

"Humanized" forms of non-human antibodies can be chimeric antibodies that contain minimal sequence derived from the non-human antibody. A humanized antibody is generally a human antibody (recipient antibody) in which residues from one or more CDRs are replaced by residues from one or more CDRs of a non-human antibody (donor antibody). The donor antibody can be any suitable non-human antibody, such as a mouse, rat, rabbit, chicken, or non-human primate antibody having a desired specificity, affinity, or biological effect. In some instances, selected framework region residues of the recipient antibody are replaced by the corresponding framework region residues from the donor antibody. Humanized antibodies may also comprise residues that are not found in either the recipient antibody or the donor antibody. In some instances, these modifications are made to further refine antibody performance.

"Caninization" can comprise a method for transferring non-canine antigen-binding information from a donor antibody to a less immunogenic canine antibody acceptor to generate treatments useful as therapeutics in dogs. In some instances, caninized forms of non-canine antibodies provided herein are chimeric antibodies that contain minimal sequence derived from non-canine antibodies. In some instances, caninized antibodies are canine antibody sequences ("acceptor" or "recipient" antibody) in which hypervariable region residues of the recipient are replaced by hypervariable region residues from a non-canine species ("donor" antibody) such as mouse, rat, rabbit, cat, dogs, goat, chicken, bovine, horse, llama, camel, dromedaries, sharks, non-human primates, human, humanized, recombinant sequence, or an engineered sequence having the desired properties. In some instances, framework region (FR) residues of the canine antibody are replaced by corresponding non-canine FR residues. In some instances, caninized antibodies include residues that are not found in the recipient antibody or in the donor antibody. In some instances, these modifications are made to further refine antibody performance. The caninized antibody may also comprise at least a portion of an immunoglobulin constant region (Fc) of a canine antibody.

"Felinization" can comprise a method for transferring non-feline antigen-binding information from a donor antibody to a less immunogenic feline antibody acceptor to generate treatments useful as therapeutics in cats. In some instances, felinized forms of non-feline antibodies provided herein are chimeric antibodies that contain minimal sequence derived from non-feline antibodies. In some instances, felinized antibodies are feline antibody sequences ("acceptor" or "recipient" antibody) in which hypervariable region residues of the recipient are replaced by hypervariable region residues from a non-feline species ("donor" antibody) such as mouse, rat, rabbit, cat, dogs, goat, chicken, bovine, horse, llama, camel, dromedaries, sharks, non-human primates, human, humanized, recombinant sequence, or an engineered sequence having the desired properties. In some instances, framework region (FR) residues of the feline antibody are replaced by corresponding non-feline FR residues. In some instances, felinized antibodies include residues that are not found in the recipient antibody or in the donor antibody. In some instances, these modifications are made to further refine antibody performance. The felinized antibody may also comprise at least a portion of an immunoglobulin constant region (Fc) of a felinize antibody.

Provided herein are libraries comprising nucleic acids encoding for a non-immunoglobulin. For example, the non-immunoglobulin is an antibody mimetic. Exemplary antibody mimetics include, but are not limited to, anticalins, affilins, affibody molecules, affimers, affitins, alphabodies, avimers, atrimers, DARPins, fynomers, Kunitz domain-based proteins, monobodies, anticalins, knottins, armadillo repeat protein-based proteins, and bicyclic peptides.

Libraries described herein comprising nucleic acids encoding for an immunoglobulin comprising variations in at least one region of the immunoglobulin. Exemplary regions of the antibody for variation include, but are not limited to, a complementarity-determining region (CDR), a variable domain, or a constant domain. In some instances, the CDR is CDR1, CDR2, or CDR3. In some instances, the CDR is a heavy domain including, but not limited to, CDRH1, CDRH2, and CDRH3. In some instances, the CDR is a light domain including, but not limited to, CDRL1, CDRL2, and CDRL3. In some instances, the variable domain is variable domain, light chain (VL) or variable domain, heavy chain (VH). In some instances, the VL domain comprises kappa or lambda chains. In some instances, the constant domain is constant domain, light chain (CL) or constant domain, heavy chain (CH).

Methods described herein provide for synthesis of libraries comprising nucleic acids encoding for an immunoglobulin, wherein each nucleic acid encodes for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the variant library comprises varied nucleic acids collectively encoding variations at multiple positions. In some instances, the variant library comprises sequences encoding for variation of at least a single codon of a CDRH1, CDRH2, CDRH3, CDRL1, CDRL2, CDRL3, VL, or VH domain. In some instances, the variant library comprises sequences encoding for variation of multiple codons of a CDRH1, CDRH2, CDRH3, CDRL1, CDRL2, CDRL3, VL, or VH domain. In some instances, the variant library comprises sequences encoding for variation of multiple codons of framework element 1 (FW1), framework element 2 (FW2), framework element 3 (FW3), or framework element 4 (FW4). An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

In some instances, the at least one region of the immunoglobulin for variation is from heavy chain V-gene family, heavy chain D-gene family, heavy chain J-gene family, light chain V-gene family, or light chain J-gene family. In some instances, the light chain V-gene family comprises immunoglobulin kappa (IGK) gene or immunoglobulin lambda (IGL). Exemplary genes include, but are not limited to, IGHV1-18, IGHV1-69, IGHV1-8, IGHV3-21, IGHV3-23, IGHV3-30/33rn, IGHV3-28, IGHV1-69, IGHV3-74, IGHV4-39, IGHV4-59/61, IGKV1-39, IGKV1-9, IGKV2-28, IGKV3-11, IGKV3-15, IGKV3-20, IGKV4-1, IGLV1-51, IGLV2-14, IGLV1-40, and IGLV3-1. In some instances, the gene is IGHV1-69, IGHV3-30, IGHV3-23, IGHV3, IGHV1-46, IGHV3-7, IGHV1, or IGHV1-8. In some instances, the gene is IGHV1-69 and IGHV3-30. In some instances, the gene is IGHJ3, IGHJ6, IGHJ, IGHJ4, IGHJ5, IGHJ2, or IGH1. In some instances, the gene is IGHJ3, IGHJ6, IGHJ, or IGHJ4.

Provided herein are libraries comprising nucleic acids encoding for immunoglobulins, wherein the libraries are synthesized with various numbers of fragments. In some instances, the fragments comprise the CDRH1, CDRH2, CDRH3, CDRL1, CDRL2, CDRL3, VL, or VH domain. In some instances, the fragments comprise framework element 1 (FW1), framework element 2 (FW2), framework element 3 (FW3), or framework element 4 (FW4). In some instances, the immunoglobulin libraries are synthesized with at least or about 2 fragments, 3 fragments, 4 fragments, 5 fragments, or more than 5 fragments. The length of each of the nucleic acid fragments or average length of the nucleic acids synthesized may be at least or about 50, 75, 100, 125, 150, 175, 200, 225, 250, 275, 300, 325, 350, 375, 400, 425, 450, 475, 500, 525, 550, 575, 600, or more than 600 base pairs. In some instances, the length is about 50 to 600, 75 to 575, 100 to 550, 125 to 525, 150 to 500, 175 to 475, 200 to 450, 225 to 425, 250 to 400, 275 to 375, or 300 to 350 base pairs.

Libraries comprising nucleic acids encoding for immunoglobulins as described herein comprise various lengths of amino acids when translated. In some instances, the length of each of the amino acid fragments or average length of the amino acid synthesized may be at least or about 15, 20, 25, 30, 35, 40, 45, 50, 55, 60, 65, 70, 75, 80, 85, 90, 95, 100, 105, 110, 115, 120, 125, 130, 135, 140, 145, 150, or more than 150 amino acids. In some instances, the length of the amino acid is about 15 to 150, 20 to 145, 25 to 140, 30 to 135, 35 to 130, 40 to 125, 45 to 120, 50 to 115, 55 to 110, 60 to 110, 65 to 105, 70 to 100, or 75 to 95 amino acids. In some instances, the length of the amino acid is about 22 amino acids to about 75 amino acids. In some instances, the immunoglobulins comprise at least or about 100, 200, 300, 400, 500, 600, 700, 800, 900, 1000, 2000, 3000, 4000, 5000, or more than 5000 amino acids.

A number of variant sequences for the at least one region of the immunoglobulin for variation are de novo synthesized using methods as described herein. In some instances, a number of variant sequences is de novo synthesized for CDRH1, CDRH2, CDRH3, CDRL1, CDRL2, CDRL3, VL, VH, or combinations thereof. In some instances, a number of variant sequences is de novo synthesized for framework element 1 (FW1), framework element 2 (FW2), framework element 3 (FW3), or framework element 4 (FW4). The number of variant sequences may be at least or about 5, 10, 15, 20, 25, 30, 35, 40, 45, 50, 55, 60, 65, 70, 75, 80, 85, 90, 95, 100, 125, 150, 175, 200, 225, 250, 275, 300, 325, 350, 375, 400, 425, 450, 475, 500, or more than 500 sequences. In some instances, the number of variant sequences is at least or about 500, 600, 700, 800, 900, 1000, 2000, 3000, 4000, 5000, 6000, 7000, 8000, or more than 8000 sequences. In some instances, the number of variant sequences is about 10 to 500, 25 to 475, 50 to 450, 75 to 425, 100 to 400, 125 to 375, 150 to 350, 175 to 325, 200 to 300, 225 to 375, 250 to 350, or 275 to 325 sequences.

Variant sequences for the at least one region of the immunoglobulin, in some instances, vary in length or sequence. In some instances, the at least one region that is de novo synthesized is for CDRH1, CDRH2, CDRH3, CDRL1, CDRL2, CDRL3, VL, VH, or combinations thereof. In some instances, the at least one region that is de novo synthesized is for framework element 1 (FW1), framework element 2 (FW2), framework element 3 (FW3), or framework element 4 (FW4). In some instances, the variant sequence comprises at least or about 1, 2, 3, 4, 5, 6, 7, 8, 9, 10, 15, 20, 25, 30, 35, 40, 45, 50, or more than 50 variant nucleotides or amino acids as compared to wild-type. In some instances, the variant sequence comprises at least or about 1, 2, 3, 4, 5, 6, 7, 8, 9, 10, 15, 20, 25, 30, 35, 40, 45, or 50 additional nucleotides or amino acids as compared to wild-type. In some instances, the variant sequence comprises at least or about 1, 2, 3, 4, 5, 6, 7, 8, 9, 10, 15, 20, 25, 30, 35, 40, 45, or 50 less nucleotides or amino acids as compared to wild-type. In some instances, the libraries comprise at least or about $10^1$, $10^2$, $10^3$, $10^4$, $10^5$, $10^6$, $10^7$, $10^8$, $10^9$, $10^{10}$, or more than $10^{10}$ variants.

Following synthesis of libraries described herein, libraries may be used for screening and analysis. For example, libraries are assayed for library displayability and panning. In some instances, displayability is assayed using a selectable tag. Exemplary tags include, but are not limited to, a radioactive label, a fluorescent label, an enzyme, a chemiluminescent tag, a colorimetric tag, an affinity tag or other labels or tags that are known in the art. In some instances, the tag is histidine, polyhistidine, myc, hemagglutinin (HA), or FLAG. In some instances, libraries are assayed by sequencing using various methods including, but not limited to, single-molecule real-time (SMRT) sequencing, Polony sequencing, sequencing by ligation, reversible terminator sequencing, proton detection sequencing, ion semiconductor sequencing, nanopore sequencing, electronic sequencing, pyrosequencing, Maxam-Gilbert sequencing, chain termination (e.g., Sanger) sequencing, +S sequencing, or sequencing by synthesis.

In some instances, the libraries are assayed for functional activity, structural stability (e.g., thermal stable or pH stable), expression, specificity, or a combination thereof. In some instances, the libraries are assayed for immunoglobulin (e.g., an antibody) capable of folding. In some instances, a region of the antibody is assayed for functional activity, structural stability, expression, specificity, folding, or a combination thereof. For example, a VH region or VL region is assayed for functional activity, structural stability, expression, specificity, folding, or a combination thereof.

DKK1 Libraries

Provided herein are DKK1 variant immunoglobulins (e.g., antibody, VHH) comprising nucleic acids encoding for immunoglobulins (e.g., antibodies) that bind to DKK1. In some instances, the immunoglobulin sequences for DKK1 binding domains are determined by interactions between the DKK1 binding domains and the DKK1.

Sequences of DKK1 binding domains based on surface interactions of DKK1 are analyzed using various methods. For example, multispecies computational analysis is performed. In some instances, a structure analysis is performed. In some instances, a sequence analysis is performed. Sequence analysis can be performed using a database known in the art. Non-limiting examples of databases include, but are not limited to, NCBI BLAST (blast.ncbi.nlm.nih.gov/Blast.cgi), UCSC Genome Browser (genome.ucsc.edu/), UniProt (www.uniprot.org/), and IUPHAR/BPS Guide to PHARMACOLOGY (guidetopharmacology.org/).

Described herein are DKK1 binding domains designed based on sequence analysis among various organisms. For example, sequence analysis is performed to identify homologous sequences in different organisms. Exemplary organisms include, but are not limited to, mouse, rat, equine, sheep, cow, primate (e.g., chimpanzee, baboon, gorilla, orangutan, monkey), dog, cat, pig, donkey, rabbit, fish, fly, and human.

Following identification of DKK1 binding domains, libraries comprising nucleic acids encoding for the DKK1 binding domains may be generated. In some instances, libraries of DKK1 binding domains comprise sequences of DKK1 binding domains designed based on conformational ligand interactions, peptide ligand interactions, small molecule ligand interactions, extracellular domains of DKK1, or antibodies that target DKK1. In some instances, libraries of DKK1 binding domains comprise sequences of DKK1 binding domains designed based on peptide ligand interactions. Libraries of DKK1 binding domains may be translated to generate protein libraries. In some instances, libraries of DKK1 binding domains are translated to generate peptide libraries, immunoglobulin libraries, derivatives thereof, or combinations thereof. In some instances, libraries of DKK1 binding domains are translated to generate protein libraries that are further modified to generate peptidomimetic libraries. In some instances, libraries of DKK1 binding domains are translated to generate protein libraries that are used to generate small molecules.

Methods described herein provide for synthesis of libraries of DKK1 binding domains comprising nucleic acids each encoding for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the libraries of DKK1 binding domains comprise varied nucleic acids collectively encoding variations at multiple positions. In some instances, the variant library comprises sequences encoding for variation of at least a single codon in a DKK1 binding domain. In some instances, the variant library comprises sequences encoding for variation of multiple codons in a DKK1 binding domain. An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

Methods described herein provide for synthesis of libraries comprising nucleic acids encoding for the DKK1 binding domains, wherein the libraries comprise sequences encoding for variation of length of the DKK1 binding domains. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons less as compared to a predetermined reference sequence. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 200, 225, 250, 275, 300, or more than 300 codons more as compared to a predetermined reference sequence.

Provided herein are DKK1 variant immunoglobulins (e.g., antibody, VHH) comprising nucleic acids encoding for immunoglobulins comprising DKK1 binding domains comprising variation in domain type, domain length, or residue variation. In some instances, the domain is a region in the immunoglobulin comprising the DKK1 binding domains. For example, the region is the VH, CDRH1, CDRH2, CDRH3, VL, CDRL1, CDRL2, or CDRL3 domain. In some instances, the domain is the DKK1 binding domain.

Methods described herein provide for synthesis of a DKK1 binding library of nucleic acids each encoding for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the DKK1 binding library comprises varied nucleic acids collectively encoding variations at multiple positions. In some instances, the variant library comprises sequences encoding for variation of at least a single codon of a VH, CDRH1, CDRH2, CDRH3, VL, CDRL1, CDRL2, or CDRL3 domain. In some instances, the variant library comprises sequences encoding for variation of at least a single codon in a DKK1 binding domain. In some instances, the variant library comprises sequences encoding for variation of multiple codons of a VH, CDRH1, CDRH2, CDRH3, VL, CDRL1, CDRL2, or CDRL3 domain. In some instances, the variant library comprises sequences encoding for variation of multiple codons in a DKK1 binding domain. An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

Methods described herein provide for synthesis of a DKK1 binding library of nucleic acids each encoding for a predetermined variant of at least one predetermined reference nucleic acid sequence, wherein the DKK1 binding library comprises sequences encoding for variation of length of a domain. In some instances, the domain is VH, CDRH1, CDRH2, CDRH3, VL, CDRL1, CDRL2, or CDRL3 domain. In some instances, the domain is the DKK1 binding domain. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons less as compared to a predetermined reference sequence. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 200, 225, 250, 275, 300, or more than 300 codons more as compared to a predetermined reference sequence.

Provided herein are DKK1 variant immunoglobulins (e.g., antibody, VHH) comprising nucleic acids encoding for immunoglobulins comprising DKK1 binding domains, wherein the DKK1 binding libraries are synthesized with various numbers of fragments. In some instances, the fragments comprise the VH, CDRH1, CDRH2, CDRH3, VL, CDRL1, CDRL2, or CDRL3 domain. In some instances, the DKK1 variant immunoglobulins (e.g., antibody, VHH) are synthesized with at least or about 2 fragments, 3 fragments, 4 fragments, 5 fragments, or more than 5 fragments. The length of each of the nucleic acid fragments or average length of the nucleic acids synthesized may be at least or about 50, 75, 100, 125, 150, 175, 200, 225, 250, 275, 300, 325, 350, 375, 400, 425, 450, 475, 500, 525, 550, 575, 600, or more than 600 base pairs. In some instances, the length is about 50 to 600, 75 to 575, 100 to 550, 125 to 525, 150 to 500, 175 to 475, 200 to 450, 225 to 425, 250 to 400, 275 to 375, or 300 to 350 base pairs.

DKK1 variant immunoglobulins (e.g., antibody, VHH) comprising nucleic acids encoding for immunoglobulins comprising DKK1 binding domains as described herein comprise various lengths of amino acids when translated. In some instances, the length of each of the amino acid fragments or average length of the amino acid synthesized may be at least or about 15, 20, 25, 30, 35, 40, 45, 50, 55, 60, 65, 70, 75, 80, 85, 90, 95, 100, 105, 110, 115, 120, 125, 130, 135, 140, 145, 150, or more than 150 amino acids. In some instances, the length of the amino acid is about 15 to 150, 20 to 145, 25 to 140, 30 to 135, 35 to 130, 40 to 125, 45 to 120, 50 to 115, 55 to 110, 60 to 110, 65 to 105, 70 to 100, or 75 to 95 amino acids. In some instances, the length of the amino acid is about 22 to about 75 amino acids.

DKK1 variant immunoglobulins (e.g., antibody, VHH) comprising de novo synthesized variant sequences encoding for immunoglobulins comprising DKK1 binding domains comprise a number of variant sequences. In some instances, a number of variant sequences is de novo synthesized for a CDRH1, CDRH2, CDRH3, CDRL1, CDRL2, CDRL3, VL, VH, or a combination thereof. In some instances, a number of variant sequences is de novo synthesized for framework element 1 (FW1), framework element 2 (FW2), framework element 3 (FW3), or framework element 4 (FW4). In some instances, a number of variant sequences is de novo synthesized for a GPCR binding domain. For example, the number of variant sequences is about 1 to about 10 sequences for the VH domain, about 108 sequences for the DKK1 binding domain, and about 1 to about 44 sequences for the VL domain. The number of variant sequences may be at least or about 5, 10, 15, 20, 25, 30, 35, 40, 45, 50, 55, 60, 65, 70, 75, 80, 85, 90, 95, 100, 125, 150, 175, 200, 225, 250, 275, 300, 325, 350, 375, 400, 425, 450, 475, 500, or more than 500 sequences. In some instances, the number of variant sequences is about 10 to 300, 25 to 275, 50 to 250, 75 to 225, 100 to 200, or 125 to 150 sequences.

Described herein are antibodies or antibody fragments thereof that binds DKK1. In some embodiments, the antibody or antibody fragment thereof comprises a sequence as set forth in Tables 4-8. In some embodiments, the antibody or antibody fragment thereof comprises a sequence that is at least or about 70%, 80%, 85%, 90%, 91%, 92%, 93%, 94%, 95%, 96%, 97%, 98%, 99%, or 100% sequence identity to a sequence as set forth in Tables 4-8.

In some instances, an antibody or antibody fragment described herein comprises a CDRH1 sequence of any one of SEQ ID NOs: 1-98 or 919-1332. In some instances, an antibody or antibody fragment described herein comprises a sequence that is at least 80% identical to a CDRH1 sequence of any one of SEQ ID NOs: 1-98 or 919-1332. In some instances, an antibody or antibody fragment described herein comprises a sequence that is at least 85% identical to a CDRH1 sequence of any one of SEQ ID NOs: 1-98 or 919-1332. In some instances, an antibody or antibody fragment described herein comprises a sequence that is at least 90% identical to a CDRH1 sequence of any one of SEQ ID NOs: 1-98 or 919-1332. In some instances, an antibody or antibody fragment described herein comprises a sequence that is at least 95% identical to a CDRH1 sequence of any one of SEQ ID NOs: 1-98 or 919-1332.

In some instances, an antibody or antibody fragment described herein comprises a CDRH2 sequence of any one of SEQ ID NOs: 99-196 or 1333-1746. In some instances, an antibody or antibody fragment described herein comprises a sequence that is at least 80% identical to a CDRH2 sequence of any one of SEQ ID NOs: 99-196 or 1333-1746. In some instances, an antibody or antibody fragment described herein comprises a sequence that is at least 85% identical to a CDRH2 sequence of any one of SEQ ID NOs: 99-196 or 1333-1746. In some instances, an antibody or antibody fragment described herein comprises a sequence that is at least 90% identical to a CDRH2 sequence of any one of SEQ ID NOs: 99-196 or 1333-1746. In some instances, an antibody or antibody fragment described herein comprises a sequence that is at least 95% identical to a CDRH2 sequence of any one of SEQ ID NOs: 99-196 or 1333-1746.

In some instances, an antibody or antibody fragment described herein comprises a CDRH3 sequence of any one of SEQ ID NOs: 197-294 or 1747-2160. In some instances, an antibody or antibody fragment described herein comprises a sequence that is at least 80% identical to a CDRH3 sequence of any one of SEQ ID NOs: 197-294 or 1747-2160. In some instances, an antibody or antibody fragment described herein comprises a sequence that is at least 85% identical to a CDRH3 sequence of any one of SEQ ID NOs: 197-294 or 1747-2160. In some instances, an antibody or antibody fragment described herein comprises a sequence that is at least 90% identical to a CDRH3 sequence of any one of SEQ ID NOs: 197-294 or 1747-2160. In some instances, an antibody or antibody fragment described herein comprises a sequence that is at least 95% identical to a CDRH3 sequence of any one of SEQ ID NOs: 197-294 or 1747-2160.

In some instances, an antibody or antibody fragment described herein comprises a CDRL1 sequence of any one of SEQ ID NOs: 2259-2464. In some instances, an antibody or antibody fragment described herein comprises a sequence that is at least 80% identical to a CDRL1 sequence of any one of SEQ ID NOs: 2259-2464. In some instances, an antibody or antibody fragment described herein comprises a sequence that is at least 85% identical to a CDRL1 sequence of any one of SEQ ID NOs: 2259-2464. In some instances, an antibody or antibody fragment described herein comprises a sequence that is at least 90% identical to a CDRL1 sequence of any one of SEQ ID NOs: 2259-2464. In some instances, an antibody or antibody fragment described herein comprises a sequence that is at least 95% identical to a CDRL1 sequence of any one of SEQ ID NOs: 2259-2464.

In some instances, an antibody or antibody fragment described herein comprises a CDRL2 sequence of any one of SEQ ID NOs: 2465-2521. In some instances, an antibody or antibody fragment described herein comprises a sequence that is at least 80% identical to a CDRL2 sequence of any one of SEQ ID NOs: 2465-2521. In some instances, an antibody or antibody fragment described herein comprises a sequence that is at least 85% identical to a CDRL2 sequence of any one of SEQ ID NOs: 2465-2521. In some instances, an antibody or antibody fragment described herein comprises a sequence that is at least 90% identical to a CDRL2 sequence of any one of SEQ ID NOs: 2465-2521. In some instances, an antibody or antibody fragment described herein comprises a sequence that is at least 95% identical to a CDRL2 sequence of any one of SEQ ID NOs: 2465-2521.

In some instances, an antibody or antibody fragment described herein comprises a CDRL3 sequence of any one of SEQ ID NOs: 2522-2727. In some instances, an antibody or antibody fragment described herein comprises a sequence that is at least 80% identical to a CDRL3 sequence of any one of SEQ ID NOs: 2522-2727. In some instances, an antibody or antibody fragment described herein comprises a sequence that is at least 85% identical to a CDRL3 sequence of any one of SEQ ID NOs: 2522-2727. In some instances, an antibody or antibody fragment described herein comprises a sequence that is at least 90% identical to a CDRL3 sequence of any one of SEQ ID NOs: 2522-2727. In some instances, an antibody or antibody fragment described herein comprises a sequence that is at least 95% identical to a CDRL3 sequence of any one of SEQ ID NOs: 2522-2727.

Described herein, in some embodiments, are antibodies or antibody fragments comprising a variable domain, heavy chain region (VH) and a variable domain, light chain region (VL), wherein the VH comprises an amino acid sequence at least about 90% identical to a sequence as set forth in any one of SEQ ID NOs: 295-392, 394-712, or 2164-2258, and wherein the VL comprises an amino acid sequence at least about 90% identical to a sequence as set forth in any one of SEQ ID NOs: 713-918. In some instances, the antibodies or antibody fragments comprise VH comprising at least or about 70%, 80%, 85%, 90%, 91%, 92%, 93%, 94%, 95%, 96%, 97%, 98%, 99%, or 100% sequence identity to any one of SEQ ID NOs: 295-392, 394-712, or 2164-2258. In some instances, the antibodies or antibody fragments comprise VL comprising at least or about 70%, 80%, 85%, 90%, 91%, 92%, 93%, 94%, 95%, 96%, 97%, 98%, 99%, or 100% sequence identity to any one of SEQ ID NOs: 713-918.

The term "sequence identity" means that two polynucleotide sequences are identical (i.e., on a nucleotide-by-nucleotide basis) over the window of comparison. The term "percentage of sequence identity" is calculated by comparing two optimally aligned sequences over the window of comparison, determining the number of positions at which the identical nucleic acid base (e.g., A, T, C, G, U, or I) occurs in both sequences to yield the number of matched positions, dividing the number of matched positions by the total number of positions in the window of comparison (i.e., the window size), and multiplying the result by 100 to yield the percentage of sequence identity. Alignment for purposes of determining percent amino acid sequence identity can be achieved in various ways that are within the skill in the art, for instance, using publicly available computer software such as EMBOSS MATCHER, EMBOSS WATER, EMBOSS STRETCHER, EMBOSS NEEDLE, EMBOSS LALIGN, BLAST, BLAST-2, ALIGN or Megalign (DNASTAR) software.

Those skilled in the art can determine appropriate parameters for measuring alignment, including any algorithms needed to achieve maximal alignment over the full length of the sequences being compared.

In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows: 100 times the fraction X/Y, where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. Unless specifically stated otherwise, all % amino acid sequence identity values used herein are obtained as described in the immediately preceding paragraph using the ALIGN-2 computer program.

The term "homology" or "similarity" between two proteins is determined by comparing the amino acid sequence and its conserved amino acid substitutes of one protein sequence to the second protein sequence. Similarity may be determined by procedures which are well-known in the art, for example, a BLAST program (Basic Local Alignment Search Tool at the National Center for Biological Information).

The terms "complementarity determining region," and "CDR," which are synonymous with "hypervariable region" or "HVR," are known in the art to refer to non-contiguous sequences of amino acids within antibody variable regions, which confer antigen specificity and/or binding affinity. In general, there are three CDRs in each heavy chain variable region (CDRH1, CDRH2, CDRH3) and three CDRs in each light chain variable region (CDRL1, CDRL2, CDRL3). "Framework regions" and "FR" are known in the art to refer to the non-CDR portions of the variable regions of the heavy and light chains. In general, there are four FRs in each full-length heavy chain variable region (FR-H1, FR-H2, FR-H3, and FR-H4), and four FRs in each full-length light chain variable region (FR-L1, FR-L2, FR-L3, and FR-L4). The precise amino acid sequence boundaries of a given CDR or FR can be readily determined using any of a number of well-known schemes, including those described by Kabat et al. (1991), "Sequences of Proteins of Immunological Interest," 5th Ed. Public Health Service, National Institutes of Health, Bethesda, MD ("Kabat" numbering scheme), Al-Lazikani et al., (1997) JMB 273,927-948 ("Chothia" numbering scheme); MacCallum et al., J. Mol. Biol. 262:732-745 (1996), "Antibody-antigen interactions: Contact analysis and binding site topography," J. Mol. Biol. 262, 732-745." ("Contact" numbering scheme); Lefranc M P et al., "IMGT unique numbering for immunoglobulin and T cell receptor variable domains and Ig superfamily V-like domains," Dev Comp Immunol, 2003 January; 27(1):55-77 ("IMGT" numbering scheme); Honegger A and Plückthun A, "Yet another numbering scheme for immunoglobulin variable domains: an automatic modeling and analysis tool," J Mol Biol, 2001 Jun. 8; 309(3):657-70, ("Aho" numbering scheme); and Whitelegg N R and Rees A R, "WAM: an improved algorithm for modelling antibodies on the WEB," Protein Eng. 2000 December; 13(12):819-24 ("AbM" numbering scheme. In certain embodiments the CDRs of the antibodies described herein can be defined by a method selected from Kabat, Chothia, IMGT, Aho, AbM, or combinations thereof.

The boundaries of a given CDR or FR may vary depending on the scheme used for identification. For example, the Kabat scheme is based on structural alignments, while the Chothia scheme is based on structural information. Numbering for both the Kabat and Chothia schemes is based upon the most common antibody region sequence lengths, with insertions accommodated by insertion letters, for example, "30a," and deletions appearing in some antibodies. The two schemes place certain insertions and deletions ("indels") at different positions, resulting in differential numbering. The Contact scheme is based on analysis of complex crystal structures and is similar in many respects to the Chothia numbering scheme.

DKK1 variant immunoglobulins (e.g., antibody, VHH) comprising de novo synthesized variant sequences encoding for immunoglobulins comprising DKK1 binding domains comprise improved diversity. For example, variants are generated by placing DKK1 binding domain variants in immunoglobulins comprising N-terminal CDRH3 variations and C-terminal CDRH3 variations. In some instances, variants include affinity maturation variants. Alternatively or in combination, variants include variants in other regions of the immunoglobulin including, but not limited to, CDRH1 and CDRH2. In some instances, the number of variants of the DKK1 variant immunoglobulins (e.g., antibody, VHH) is at least or about $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$, $10^{20}$, or more than $10^{20}$ non-identical sequences.

In some instances, the at least one region of the antibody for variation is from heavy chain V-gene family, heavy chain D-gene family, heavy chain J-gene family, light chain V-gene family, or light chain J-gene family. In some instances, the light chain V-gene family comprises immunoglobulin kappa (IGK) gene or immunoglobulin lambda (IGL). Exemplary regions of the antibody for variation include, but are not limited to, IGHV1-18, IGHV1-69, IGHV1-8, IGHV3-21, IGHV3-23, IGHV3-30/33rn, IGHV3-28, IGHV1-69, IGHV3-74, IGHV4-39, IGHV4-59/61, IGKV1-39, IGKV1-9, IGKV2-28, IGKV3-11, IGKV3-15, IGKV3-20, IGKV4-1, IGLV1-51, IGLV2-14, IGLV1-40, and IGLV3-1. In some instances, the gene is IGHV1-69, IGHV3-30, IGHV3-23, IGHV3, IGHV1-46, IGHV3-7, IGHV1, or IGHV1-8. In some instances, the gene is IGHV1-69 and IGHV3-30. In some instances, the region of the antibody for variation is IGHJ3, IGHJ6, IGHJ, IGHJ4, IGHJ5, IGHJ2, or IGH1. In some instances, the region of the antibody for variation is IGHJ3, IGHJ6, IGHJ, or IGHJ4. In some instances, the at least one region of the antibody for variation is IGHV1-69, IGHV3-23, IGKV3-20, IGKV1-39, or combinations thereof. In some instances, the at least one region of the antibody for variation is IGHV1-69 and IGKV3-20, In some instances, the at least one region of the antibody for variation is IGHV1-69 and IGKV1-39. In some instances, the at least one region of the antibody for variation is IGHV3-23 and IGKV3-20. In some instances, the at least one region of the antibody for variation is IGHV3-23 and IGKV1-39.

Provided herein are libraries comprising nucleic acids encoding for a DKK1 antibody comprising variation in at least one region of the antibody, wherein the region is the CDR region. In some instances, the DKK1 antibody is a single domain antibody comprising one heavy chain variable domain such as a VHH antibody. In some instances, the VHH antibody comprises variation in one or more CDR regions. In some instances, libraries described herein comprise at least or about 1, 10, 20, 30, 40, 50, 60, 70, 80, 90, 100, 200, 300, 400, 500, 600, 700, 800, 900, 1000, 1200, 1400, 1600, 1800, 2000, 2400, 2600, 2800, 3000, or more than 3000 sequences of a CDR1, CDR2, or CDR3. In some instances, libraries described herein comprise at least or about $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$, $10^{20}$, or more than $10^{20}$ sequences of a CDR1, CDR2, or CDR3. For example, the libraries comprise at least 2000 sequences of a CDR1, at least 1200 sequences for CDR2, and at least 1600 sequences for CDR3. In some instances, each sequence is non-identical.

In some instances, the CDR1, CDR2, or CDR3 is of a variable domain, light chain (VL). CDR1, CDR2, or CDR3 of a variable domain, light chain (VL) can be referred to as CDRL1, CDRL2, or CDRL3, respectively. In some instances, libraries described herein comprise at least or about 1, 2, 3, 4, 5, 6, 7, 8, 9, 10, 20, 30, 40, 50, 60, 70, 80, 90, 100, 200, 300, 400, 500, 600, 700, 800, 900, 1000, 1200, 1400, 1600, 1800, 2000, 2400, 2600, 2800, 3000, or more than 3000 sequences of a CDR1, CDR2, or CDR3 of the VL. In some instances, libraries described herein comprise at least or about $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$, $10^{20}$, or more than $10^{20}$ sequences of a CDR1, CDR2, or CDR3 of the VL. For example, the libraries comprise at least 20 sequences of a CDR1 of the VL, at least 4 sequences of a CDR2 of the VL, and at least 140 sequences of a CDR3 of the VL. In some instances, the libraries comprise at least 2 sequences of a CDR1 of the VL, at least 1 sequence of CDR2 of the VL, and at least 3000 sequences of a CDR3 of the VL. In some instances, the VL is IGKV1-39, IGKV1-9, IGKV2-28, IGKV3-11, IGKV3-15, IGKV3-20, IGKV4-1, IGLV1-51, IGLV2-14, IGLV1-40, or IGLV3-1. In some instances, the VL is IGKV2-28. In some instances, the VL is IGLV1-51.

In some instances, the CDR1, CDR2, or CDR3 is of a variable domain, heavy chain (VH). CDR1, CDR2, or CDR3 of a variable domain, heavy chain (VH) can be referred to as CDRH1, CDRH2, or CDRH3, respectively. In some instances, libraries described herein comprise at least or about 1, 2, 3, 4, 5, 6, 7, 8, 9, 10, 20, 30, 40, 50, 60, 70, 80, 90, 100, 200, 300, 400, 500, 600, 700, 800, 900, 1000, 1200, 1400, 1600, 1800, 2000, 2400, 2600, 2800, 3000, or more than 3000 sequences of a CDR1, CDR2, or CDR3 of the VH. In some instances, libraries described herein comprise at least or about $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$, $10^{20}$, or more than $10^{20}$ sequences of a CDR1, CDR2, or CDR3 of the VH. For example, the libraries comprise at least 30 sequences of a CDR1 of the VH, at least 570 sequences of a CDR2 of the VH, and at least 108 sequences of a CDR3 of the VH. In some instances, the libraries comprise at least 30 sequences of a CDR1 of the VH, at least 860 sequences of a CDR2 of the VH, and at least 107 sequences of a CDR3 of the VH. In some instances, the VH is IGHV1-18, IGHV1-69, IGHV1-8 IGHV3-21, IGHV3-23, IGHV3-30/33rn, IGHV3-28, IGHV3-74, IGHV4-39, or IGHV4-59/61. In some instances, the VH is IGHV1-69, IGHV3-30, IGHV3-23, IGHV3, IGHV1-46, IGHV3-7, IGHV1, or IGHV1-8. In some instances, the VH is IGHV1-69 or IGHV3-30. In some instances, the VH is IGHV3-23.

Libraries as described herein, in some embodiments, comprise varying lengths of a CDRL1, CDRL2, CDRL3, CDRH1, CDRH2, or CDRH3. In some instances, the length of the CDRL1, CDRL2, CDRL3, CDRH1, CDRH2, or CDRH3 comprises at least or about 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, or more than 90 amino acids in length. For example, the CDRH3 comprises at least or about 12, 15, 16, 17, 20, 21, or 23 amino acids in length. In some instances, the CDRL1, CDRL2, CDRL3, CDRH1, CDRH2, or CDRH3 comprises a range of about 1 to about 10, about 5 to about 15, about 10 to about 20, or about 15 to about 30 amino acids in length.

Libraries comprising nucleic acids encoding for antibodies having variant CDR sequences as described herein comprise various lengths of amino acids when translated. In some instances, the length of each of the amino acid fragments or average length of the amino acid synthesized may be at least or about 15, 20, 25, 30, 35, 40, 45, 50, 55, 60, 65, 70, 75, 80, 85, 90, 95, 100, 105, 110, 115, 120, 125, 130, 135, 140, 145, 150, or more than 150 amino acids. In some instances, the length of the amino acid is about 15 to 150, 20 to 145, 25 to 140, 30 to 135, 35 to 130, 40 to 125, 45 to 120, 50 to 115, 55 to 110, 60 to 110, 65 to 105, 70 to 100, or 75 to 95 amino acids. In some instances, the length of the amino acid is about 22 amino acids to about 75 amino acids. In some instances, the antibodies comprise at least or about 100, 200, 300, 400, 500, 600, 700, 800, 900, 1000, 2000, 3000, 4000, 5000, or more than 5000 amino acids.

Ratios of the lengths of a CDRL1, CDRL2, CDRL3, CDRH1, CDRH2, or CDRH3 may vary in libraries described herein. In some instances, a CDRL1, CDRL2, CDRL3, CDRH1, CDRH2, or CDRH3 comprising at least or about 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, or more than 90 amino acids in length comprises about 10%, 20%, 30%, 40%, 50%, 60%, 70%, 80%, 90%, or more than 90% of the library. For example, a CDRH3 comprising about 23 amino acids in length is present in the library at 40%, a CDRH3 comprising about 21 amino acids in length is present in the library at 30%, a CDRH3 comprising about 17 amino acids in length is present in the library at 20%, and a CDRH3 comprising about 12 amino acids in length is present in the library at 10%. In some instances, a CDRH3 comprising about 20 amino acids in length is present in the library at 40%, a CDRH3 comprising about 16 amino acids in length is present in the library at 30%, a CDRH3 comprising about 15 amino acids in length is present in the library at 20%, and a CDRH3 comprising about 12 amino acids in length is present in the library at 10%.

Libraries as described herein encoding for a VHH antibody comprise variant CDR sequences that are shuffled to generate a library with a theoretical diversity of at least or about $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$, $10^{20}$, or more than $10^{20}$ sequences. In some instances, the library has a final library diversity of at least or about $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$, $10^{20}$, or more than $10^{20}$ sequences.

Provided herein are DKK1 variant immunoglobulins (e.g., antibody, VHH) encoding for an immunoglobulin. In some instances, the DKK1 immunoglobulin is an antibody. In some instances, the DKK1 immunoglobulin is a VHH antibody. In some instances, the DKK1 immunoglobulin comprises a binding affinity (e.g., kD) to DKK1 of less than 1 nM, less than 1.2 nM, less than 2 nM, less than 5 nM, less than 10 nM, less than 11 nm, less than 13.5 nM, less than 15 nM, less than 20 nM, less than 25 nM, or less than 30 nM. In some instances, the DKK1 immunoglobulin comprises a kD of less than 1 nM. In some instances, the DKK1 immunoglobulin comprises a kD of less than 1.2 nM. In some instances, the DKK1 immunoglobulin comprises a kD of less than 2 nM. In some instances, the DKK1 immunoglobulin comprises a kD of less than 5 nM. In some instances, the DKK1 immunoglobulin comprises a kD of less than 10 nM. In some instances, the DKK1 immunoglobulin comprises a kD of less than 13.5 nM. In some instances, the DKK1 immunoglobulin comprises a kD of less than 15 nM. In some instances, the DKK1 immunoglobulin comprises a kD of less than 20 nM. In some instances, the DKK1 immunoglobulin comprises a kD of less than 25 nM. In some instances, the DKK1 immunoglobulin comprises a kD of less than 30 nM.

Provided herein are DKK1 variant immunoglobulins (e.g., antibody, VHH) encoding for an immunoglobulin, wherein the immunoglobulin comprises a long half-life. In some instances, the half-life of the DKK1 immunoglobulin is at least or about 12 hours, 24 hours 36 hours, 48 hours, 60 hours, 72 hours, 84 hours, 96 hours, 108 hours, 120 hours, 140 hours, 160 hours, 180 hours, 200 hours, or more than 200 hours. In some instances, the half-life of the DKK1 immunoglobulin is in a range of about 12 hours to about 300 hours, about 20 hours to about 280 hours, about 40 hours to about 240 hours, or about 60 hours to about 200 hours.

DKK1 immunoglobulins as described herein may comprise improved properties. In some instances, the DKK1 immunoglobulins are monomeric. In some instances, the DKK1 immunoglobulins are not prone to aggregation. In some instances, at least or about 70%, 75%, 80%, 85%, 90%, 95%, or 99% of the DKK1 immunoglobulins are monomeric. In some instances, the DKK1 immunoglobulins are thermostable. In some instances, the DKK1 immunoglobulins result in reduced non-specific binding.

Following synthesis of DKK1 variant immunoglobulins (e.g., antibody, VHH) comprising nucleic acids encoding immunoglobulins comprising DKK1 binding domains, libraries may be used for screening and analysis. For example, libraries are assayed for library displayability and panning. In some instances, displayability is assayed using a selectable tag. Exemplary tags include, but are not limited to, a radioactive label, a fluorescent label, an enzyme, a chemiluminescent tag, a colorimetric tag, an affinity tag or other labels or tags that are known in the art. In some instances, the tag is histidine, polyhistidine, myc, hemagglutinin (HA), or FLAG. In some instances, the DKK1 variant immunoglobulins (e.g., antibody, VHH) comprises nucleic acids encoding immunoglobulins with multiple tags such as GFP, FLAG, and Lucy as well as a DNA barcode. In some instances, libraries are assayed by sequencing using various methods including, but not limited to, single-molecule real-time (SMRT) sequencing, Polony sequencing, sequencing by ligation, reversible terminator sequencing, proton detection sequencing, ion semiconductor sequencing, nanopore sequencing, electronic sequencing, pyrosequencing, Maxam-Gilbert sequencing, chain termination (e.g., Sanger) sequencing, +S sequencing, or sequencing by synthesis.

Expression Systems

Provided herein are libraries comprising nucleic acids encoding for immunoglobulins comprising DKK1 binding domains, wherein the libraries have improved specificity, stability, expression, folding, or downstream activity. In some instances, libraries described herein are used for screening and analysis.

Provided herein are libraries comprising nucleic acids encoding for immunoglobulins comprising DKK1 binding domains, wherein the nucleic acid libraries are used for screening and analysis. In some instances, screening and analysis comprise in vitro, in vivo, or ex vivo assays. Cells for screening include primary cells taken from living subjects or cell lines. Cells may be from prokaryotes (e.g., bacteria and fungi) or eukaryotes (e.g., animals and plants). Exemplary animal cells include, without limitation, those from a mouse, rabbit, primate, and insect. In some instances, cells for screening include a cell line including, but not limited to, Chinese Hamster Ovary (CHO) cell line, human embryonic kidney (HEK) cell line, or baby hamster kidney (BHK) cell line. In some instances, nucleic acid libraries described herein may also be delivered to a multicellular organism. Exemplary multicellular organisms include, without limitation, a plant, a mouse, rabbit, primate, and insect.

Nucleic acid libraries or protein libraries encoded thereof described herein may be screened for various pharmacological or pharmacokinetic properties. In some instances, the libraries are screened using in vitro assays, in vivo assays, or ex vivo assays. For example, in vitro pharmacological or pharmacokinetic properties that are screened include, but are not limited to, binding affinity, binding specificity, and binding avidity. Exemplary in vivo pharmacological or pharmacokinetic properties of libraries described herein that are screened include, but are not limited to, therapeutic efficacy, activity, preclinical toxicity properties, clinical efficacy properties, clinical toxicity properties, immunogenicity, potency, and clinical safety properties.

Pharmacological or pharmacokinetic properties that may be screened include, but are not limited to, cell binding affinity and cell activity. For example, cell binding affinity assays or cell activity assays are performed to determine agonistic, antagonistic, or allosteric effects of libraries described herein. In some instances, libraries as described herein are compared to cell binding or cell activity of ligands of DKK1.

Libraries as described herein may be screened in cell-based assays or in non-cell-based assays. Examples of non-cell-based assays include, but are not limited to, using viral particles, using in vitro translation proteins, and using proteoliposomes with DKK1.

Nucleic acid libraries as described herein may be screened by sequencing. In some instances, next generation sequence is used to determine sequence enrichment of DKK1 binding variants. In some instances, V gene distribution, J gene distribution, V gene family, CDR3 counts per length, or a combination thereof is determined. In some instances, clonal frequency, clonal accumulation, lineage accumulation, or a combination thereof is determined. In some instances, number of sequences, sequences with VH clones, clones, clones greater than 1, clonotypes, clonotypes greater than 1, lineages, simpsons, or a combination thereof is determined. In some instances, a percentage of non-identical CDR3s is determined. For example, the percentage of non-identical CDR3s is calculated as the number of non-identical CDR3s in a sample divided by the total number of sequences that had a CDR3 in the sample.

Provided herein are nucleic acid libraries, wherein the nucleic acid libraries may be expressed in a vector. Expression vectors for inserting nucleic acid libraries disclosed herein may comprise eukaryotic or prokaryotic expression vectors. Exemplary expression vectors include, without limitation, mammalian expression vectors: pSF-CMV-NEO-NH2-PPT-3XFLAG, pSF-CMV-NEO-COOH-3XFLAG, pSF-CMV-PURO-NH2-GST-TEV, pSF-OXB20-COOH-TEV-FLAG(R)-6His, pCEP4 pDEST27, pSF-CMV-Ub-KrYFP, pSF-CMV-FMDV-daGFP, pEF1a-mCherry-N1 Vector, pEFla-tdTomato Vector, pSF-CMV-FMDV-Hygro, pSF-CMV-PGK-Puro, pMCP-tag(m), and pSF-CMV—PURO-NH2-CMYC; bacterial expression vectors: pSF-OXB20-BetaGal, pSF-OXB20-Fluc, pSF-OXB20, and pSF-Tac; plant expression vectors: pRI 101-AN DNA and pCambia2301; and yeast expression vectors: pTYB21 and pKLAC2, and insect vectors: pAc5.1/V5-His A and pDEST8. In some instances, the vector is pcDNA3 or pcDNA3.1.

Described herein are nucleic acid libraries that are expressed in a vector to generate a construct comprising an immunoglobulin comprising sequences of DKK1 binding domains. In some instances, a size of the construct varies. In some instances, the construct comprises at least or about 500, 600, 700, 800, 900, 1000, 1100, 1300, 1400, 1500, 1600, 1700, 1800, 2000, 2400, 2600, 2800, 3000, 3200, 3400, 3600, 3800, 4000, 4200, 4400, 4600, 4800, 5000, 6000, 7000, 8000, 9000, 10000, or more than 10000 bases. In some instances, a the construct comprises a range of about 300 to 1,000, 300 to 2,000, 300 to 3,000, 300 to 4,000, 300 to 5,000, 300 to 6,000, 300 to 7,000, 300 to 8,000, 300 to 9,000, 300 to 10,000, 1,000 to 2,000, 1,000 to 3,000, 1,000 to 4,000, 1,000 to 5,000, 1,000 to 6,000, 1,000 to 7,000, 1,000 to 8,000, 1,000 to 9,000, 1,000 to 10,000, 2,000 to 3,000, 2,000 to 4,000, 2,000 to 5,000, 2,000 to 6,000, 2,000 to 7,000, 2,000 to 8,000, 2,000 to 9,000, 2,000 to 10,000, 3,000 to 4,000, 3,000 to 5,000, 3,000 to 6,000, 3,000 to 7,000, 3,000 to 8,000, 3,000 to 9,000, 3,000 to 10,000, 4,000 to 5,000, 4,000 to 6,000, 4,000 to 7,000, 4,000 to 8,000, 4,000 to 9,000, 4,000 to 10,000, 5,000 to 6,000, 5,000 to 7,000, 5,000 to 8,000, 5,000 to 9,000, 5,000 to 10,000, 6,000 to 7,000, 6,000 to 8,000, 6,000 to 9,000, 6,000 to 10,000, 7,000 to 8,000, 7,000 to 9,000, 7,000 to 10,000, 8,000 to 9,000, 8,000 to 10,000, or 9,000 to 10,000 bases.

Provided herein are libraries comprising nucleic acids encoding for immunoglobulins, wherein the nucleic acid libraries are expressed in a cell. In some instances, the libraries are synthesized to express a reporter gene. Exemplary reporter genes include, but are not limited to, acetohydroxyacid synthase (AHAS), alkaline phosphatase (AP), beta galactosidase (LacZ), beta glucoronidase (GUS), chloramphenicol acetyltransferase (CAT), green fluorescent protein (GFP), red fluorescent protein (RFP), yellow fluorescent protein (YFP), cyan fluorescent protein (CFP), cerulean fluorescent protein, citrine fluorescent protein, orange fluorescent protein, cherry fluorescent protein, turquoise fluorescent protein, blue fluorescent protein, horseradish peroxidase (HRP), luciferase (Luc), nopaline synthase (NOS), octopine synthase (OCS), luciferase, and derivatives thereof. Methods to determine modulation of a reporter gene are well known in the art, and include, but are not limited to, fluorometric methods (e.g. fluorescence spectroscopy, Fluorescence Activated Cell Sorting (FACS), fluorescence microscopy), and antibiotic resistance determination.

Diseases and Disorders

Provided herein are DKK1 variant immunoglobulins (e.g., antibody, VHH) comprising nucleic acids encoding for immunoglobulins (e.g., antibodies) comprising DKK1 binding domains that may have therapeutic effects. In some instances, the DKK1 variant immunoglobulins (e.g., antibody, VHH) result in protein when translated that is used to treat a disease or disorder. In some instances, the protein is an immunoglobulin. In some instances, the protein is a peptidomimetic.

Exemplary diseases include, but are not limited to, cancer (e.g., gastro-esophageal cancer, endometrial cancer, ovarian cancer, prostate cancer, liver cancer, etc.), inflammatory diseases or disorders, a metabolic disease or disorder, a cardiovascular disease or disorder, a respiratory disease or disorder, pain, a digestive disease or disorder, a reproductive disease or disorder, an endocrine disease or disorder, or a neurological disease or disorder. In some instances, the cancer is a solid cancer or a hematologic cancer. In some instances, a modulator of DKK1 as described herein is used for treatment of weight gain (or for inducing weight loss), treatment of obesity, or treatment of Type II diabetes. In some instances, the DKK1 modulator is used for treating hypoglycemia. In some instances, the DKK1 modulator is used for treating post-bariatric hypoglycemia. In some instances, the DKK1 modulator is used for treating severe hypoglycemia. In some instances, the DKK1 modulator is used for treating hyperinsulinism. In some instances, the DKK1modulator is used for treating congenital hyperinsulinism.

DKK1 can be tumorigenic in cancer. DKK1 can also be immunosuppressive (e.g., via myeloid-derived suppressor cells (MDSCs) or natural killer (NK) cells). DKK1 can lead to immune suppression through T cell inactivation, MDSC accumulation, or NK cell clearance. DKK1 can inhibit Wnt binding to low-density lipoprotein (LDL) receptor related protein 5 (LRP5). DKK1 can inhibit Wnt binding to LDL receptor related protein 6 (LRP6). DKK1 can inhibit Wnt binding to an LRP5/6 complex. Mutations in Wnt activating genes can lead to increased DKK1 expression.

Antagonist mAb can activate an innate immune response with anti-angiogenic and direct antitumor effects, binding and removing DKK1 from the tumor microenvironment. Tumors with Wnt activating mutations can responded to DKK1 antagonism. For example, high tumoral DKK1 can be associated with longer progression-free survival in esophagogastic cancer patients.

In some instances, the subject is a mammal. In some instances, the subject is a mouse, rabbit, dog, or human. Subjects treated by methods described herein may be infants, adults, or children. Pharmaceutical compositions comprising antibodies or antibody fragments as described herein may be administered intravenously or subcutaneously.

Described herein are pharmaceutical compositions comprising antibodies or antibody fragment thereof that binds DKK1. In some embodiments, the antibody or antibody fragment thereof comprises a sequence as set forth in Tables 4-8. In some embodiments, the antibody or antibody fragment thereof comprises a sequence that is at least or about 70%, 80%, 85%, 90%, 91%, 92%, 93%, 94%, 95%, 96%, 97%, 98%, 99%, or 100% sequence identity to a sequence as set forth in Tables 4-8.

In some instances, a pharmaceutical composition comprises an antibody or antibody fragment described herein comprising a CDRH1 sequence of any one of SEQ ID NOs: 1-98 or 919-1332. In some instances, a pharmaceutical composition comprises an antibody or antibody fragment described herein comprising a sequence that is at least 80% identical to a CDRH1 sequence of any one of SEQ ID NOs: 1-98 or 919-1332. In some instances, a pharmaceutical composition comprises an antibody or antibody fragment described herein comprising a sequence that is at least 85% identical to a CDRH1 sequence of any one of SEQ ID NOs: 1-98 or 919-1332. In some instances, a pharmaceutical composition comprises an antibody or antibody fragment described herein comprising a sequence that is at least 90% identical to a CDRH1 sequence of any one of SEQ ID NOs: 1-98 or 919-1332. In some instances, a pharmaceutical composition comprises an antibody or antibody fragment described herein comprising a sequence that is at least 95% identical to a CDRH1 sequence of any one of SEQ ID NOs: 1-98 or 919-1332.

In some instances, a pharmaceutical composition comprises an antibody or antibody fragment described herein comprising a CDRH2 sequence of any one of SEQ ID NOs: 99-196 or 1333-1746. In some instances, a pharmaceutical composition comprises an antibody or antibody fragment described herein comprising a sequence that is at least 80% identical to a CDRH2 sequence of any one of SEQ ID NOs: 99-196 or 1333-1746. In some instances, a pharmaceutical composition comprises an antibody or antibody fragment described herein comprising a sequence that is at least 85% identical to a CDRH2 sequence of any one of SEQ ID NOs: 99-196 or 1333-1746. In some instances, a pharmaceutical composition comprises an antibody or antibody fragment described herein comprising a sequence that is at least 90% identical to a CDRH2 sequence of any one of SEQ ID NOs: 99-196 or 1333-1746. In some instances, a pharmaceutical composition comprises an antibody or antibody fragment described herein comprising a sequence that is at least 95% identical to a CDRH2 sequence of any one of SEQ ID NOs: 99-196 or 1333-1746.

In some instances, a pharmaceutical composition comprises an antibody or antibody fragment described herein comprising a CDRH3 sequence of any one of SEQ ID NOs: 197-294 or 1747-2160. In some instances, a pharmaceutical composition comprises an antibody or antibody fragment described herein comprising a sequence that is at least 80% identical to a CDRH3 sequence of any one of SEQ ID NOs: 197-294 or 1747-2160. In some instances, a pharmaceutical composition comprises an antibody or antibody fragment described herein comprising a sequence that is at least 85% identical to a CDRH3 sequence of any one of SEQ ID NOs: 197-294 or 1747-2160. In some instances, a pharmaceutical composition comprises an antibody or antibody fragment described herein comprising a sequence that is at least 90% identical to a CDRH3 sequence of any one of SEQ ID NOs: 197-294 or 1747-2160. In some instances, a pharmaceutical composition comprises an antibody or antibody fragment described herein comprising a sequence that is at least 95% identical to a CDRH3 sequence of any one of SEQ ID NOs: 197-294 or 1747-2160.

In some instances, a pharmaceutical composition comprises an antibody or antibody fragment described herein comprising a CDRL1 sequence of any one of SEQ ID NOs: 2259-2464. In some instances, a pharmaceutical composition comprises an antibody or antibody fragment described herein comprising a sequence that is at least 80% identical to a CDRL1 sequence of any one of SEQ ID NOs: 2259-2464. In some instances, a pharmaceutical composition comprises an antibody or antibody fragment described herein comprising a sequence that is at least 85% identical to a CDRL1 sequence of any one of SEQ ID NOs: 2259-2464. In some instances, a pharmaceutical composition comprises an antibody or antibody fragment described herein comprising a sequence that is at least 90% identical to a CDRL1 sequence of any one of SEQ ID NOs: 2259-2464. In some instances, a pharmaceutical composition comprises an antibody or antibody fragment described herein comprising a sequence that is at least 95% identical to a CDRL1 sequence of any one of SEQ ID NOs: 2259-2464.

In some instances, a pharmaceutical composition comprises an antibody or antibody fragment described herein comprising a CDRL2 sequence of any one of SEQ ID NOs: 2465-2521. In some instances, a pharmaceutical composition comprises an antibody or antibody fragment described herein comprising a sequence that is at least 80% identical to a CDRL2 sequence of any one of SEQ ID NOs: 2465-2521. In some instances, a pharmaceutical composition comprises an antibody or antibody fragment described herein comprising a sequence that is at least 85% identical to a CDRL2 sequence of any one of SEQ ID NOs: 2465-2521. In some instances, a pharmaceutical composition comprises an antibody or antibody fragment described herein comprising a sequence that is at least 90% identical to a CDRL2 sequence of any one of SEQ ID NOs: 2465-2521. In some instances, a pharmaceutical composition comprises an antibody or antibody fragment described herein comprising a sequence that is at least 95% identical to a CDRL2 sequence of any one of SEQ ID NOs: 2465-2521.

In some instances, a pharmaceutical composition comprises an antibody or antibody fragment described herein comprising a CDRL3 sequence of any one of SEQ ID NOs: 2522-2727. In some instances, a pharmaceutical composition comprises an antibody or antibody fragment described herein comprising a sequence that is at least 80% identical to a CDRL3 sequence of any one of SEQ ID NOs: 2522-2727. In some instances, a pharmaceutical composition comprises an antibody or antibody fragment described herein comprising a sequence that is at least 85% identical to a CDRL3 sequence of any one of SEQ ID NOs: 2522-2727. In some instances, a pharmaceutical composition comprises an antibody or antibody fragment described herein comprising a sequence that is at least 90% identical to a C CDRL3 sequence of any one of SEQ ID NOs: 2522-2727. In some instances, a pharmaceutical composition comprises an antibody or antibody fragment described herein comprising a sequence that is at least 95% identical to a CDRL3 sequence of any one of SEQ ID NOs: 2522-2727.

In some embodiments, the antibody or antibody fragment comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRH1 is as set forth in any one of SEQ ID NOs: 1-98 or 919-1332; (b) an amino acid sequence of CDRH2 is as set forth in any one of SEQ ID NOs: 99-196 or 1333-1746; and (c) an amino acid sequence of CDRH3 is as set forth in any one of SEQ ID NOs: 197-294 or 1747-2160. In some embodiments, the antibody or antibody fragment comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRH1 is at least or about 80%, 85%, 90%, or 95% identical to any one of SEQ ID NOs: 1-98; (b) an amino acid sequence of CDRH2 is at least or about 80%, 85%, 90%, or 95% identical to any one of SEQ ID NOs: 99-196; and (c) an amino acid sequence of CDRH3 is at least or about 80%, 85%, 90%, or 95% identical to any one of SEQ ID NOs: 197-294.

In some embodiments, the antibody or antibody fragment comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRL1 is as set forth in any one of SEQ ID NOs: 2259-2464; (b) an amino acid sequence of CDRL2 is as set forth in any one of SEQ ID NOs: 2465-2521; and (c) an amino acid sequence of CDRL3 is as set forth in any one of SEQ ID NOs: 2522-2727. In some embodiments, the antibody or antibody fragment comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRL1 is at least or about 80%, 85%, 90%, or 95% identical to any one of SEQ ID NOs: 2259-2464; (b) an amino acid sequence of CDRL2 is at least or about 80%, 85%, 90%, or 95% identical to any one of SEQ ID NOs: 2465-2521; and (c) an amino acid sequence of CDRL3 is at least or about 80%, 85%, 90%, or 95% identical to any one of SEQ ID NOs: 2522-2727.

Described herein, in some embodiments, are antibodies or antibody fragments comprising a variable domain, heavy chain region (VH), wherein the VH comprises an amino acid sequence at least about 90% identical to a sequence as set forth in any one of SEQ ID NOs: 295-392, 394-712, or 2164-2258. In some instances, the antibodies or antibody fragments comprise VH comprising at least or about 70%, 80%, 85%, 90%, 91%, 92%, 93%, 94%, 95%, 96%, 97%, 98%, 99%, or 100% sequence identity to any one of SEQ ID NOs: 295-392, 394-712, or 2164-2258.

Described herein, in some embodiments, are antibodies or antibody fragments comprising a variable domain, light chain region (VL), wherein the VL comprises an amino acid sequence at least about 90% identical to a sequence as set forth in any one of SEQ ID NOs: 713-918. In some instances, the antibodies or antibody fragments comprise VL comprising at least or about 70%, 80%, 85%, 90%, 91%, 92%, 93%, 94%, 95%, 96%, 97%, 98%, 99%, or 100% sequence identity to any one of SEQ ID NOs: 713-918.

Variant Libraries
Codon Variation

Variant nucleic acid libraries described herein may comprise a plurality of nucleic acids, wherein each nucleic acid encodes for a variant codon sequence compared to a reference nucleic acid sequence. In some instances, each nucleic acid of a first nucleic acid population contains a variant at a single variant site. In some instances, the first nucleic acid population contains a plurality of variants at a single variant site such that the first nucleic acid population contains more than one variant at the same variant site. The first nucleic acid population may comprise nucleic acids collectively encoding multiple codon variants at the same variant site. The first nucleic acid population may comprise nucleic acids collectively encoding up to 19 or more codons at the same position. The first nucleic acid population may comprise nucleic acids collectively encoding up to 60 variant triplets at the same position, or the first nucleic acid population may comprise nucleic acids collectively encoding up to 61 different triplets of codons at the same position. Each variant may encode for a codon that results in a different amino acid during translation.

A nucleic acid population may comprise varied nucleic acids collectively encoding up to 20 codon variations at multiple positions. In such cases, each nucleic acid in the population comprises variation for codons at more than one position in the same nucleic acid. In some instances, each nucleic acid in the population comprises variation for codons at 1, 2, 3, 4, 5, 6, 7, 8, 9, 10, 11, 12, 13, 14, 15, 16, 17, 18, 19, 20 or more codons in a single nucleic acid. In some instances, each variant long nucleic acid comprises variation for codons at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more codons in a single long nucleic acid. In some instances, the variant nucleic acid population comprises variation for codons at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more codons in a single nucleic acid. In some instances, the variant nucleic acid population comprises variation for codons in at least about 10, 20, 30, 40, 50, 60, 70, 80, 90, 100 or more codons in a single long nucleic acid.

Highly Parallel Nucleic Acid Synthesis

Provided herein is a platform approach utilizing miniaturization, parallelization, and vertical integration of the end-to-end process from polynucleotide synthesis to gene assembly within nanowells on silicon to create a revolutionary synthesis platform. Devices described herein provide, with the same footprint as a 96-well plate, a silicon synthesis platform capable of increasing throughput by a factor of up to 1,000 or more compared to traditional synthesis methods, with production of up to approximately 1,000,000 or more polynucleotides, or 10,000 or more genes in a single highly-parallelized run.

With the advent of next-generation sequencing, high resolution genomic data has become an important factor for studies that delve into the biological roles of various genes in both normal biology and disease pathogenesis. At the core of this research is the central dogma of molecular biology and the concept of "residue-by-residue transfer of sequential information." Genomic information encoded in the DNA is transcribed into a message that is then translated into the protein that is the active product within a given biological pathway.

Another exciting area of study is on the discovery, development and manufacturing of therapeutic molecules focused on a highly-specific cellular target. High diversity DNA sequence libraries are at the core of development pipelines for targeted therapeutics. Gene mutants are used to express proteins in a design, build, and test protein engineering cycle that ideally culminates in an optimized gene for high expression of a protein with high affinity for its therapeutic target. As an example, consider the binding pocket of a receptor. The ability to test all sequence permutations of all residues within the binding pocket simultaneously will allow for a thorough exploration, increasing chances of success. Saturation mutagenesis, in which a researcher attempts to generate all possible mutations at a specific site within the receptor, represents one approach to this development challenge. Though costly and time- and labor-intensive, it enables each variant to be introduced into each position. In contrast, combinatorial mutagenesis, where a few selected positions or short stretch of DNA may be modified extensively, generates an incomplete repertoire of variants with biased representation.

To accelerate the drug development pipeline, a library with the desired variants available at the intended frequency in the right position available for testing—in other words, a precision library—enables reduced costs as well as turn-around time for screening. Provided herein are methods for synthesizing nucleic acid synthetic variant libraries which provide for precise introduction of each intended variant at the desired frequency. To the end user, this translates to the ability to not only thoroughly sample sequence space but also be able to query these hypotheses in an efficient manner, reducing cost and screening time. Genome-wide editing can elucidate important pathways, libraries where each variant and sequence permutation can be tested for optimal functionality, and thousands of genes can be used to reconstruct entire pathways and genomes to re-engineer biological systems for drug discovery.

In a first example, a drug itself can be optimized using methods described herein. For example, to improve a specified function of an antibody, a variant polynucleotide library encoding for a portion of the antibody is designed and synthesized. A variant nucleic acid library for the antibody can then be generated by processes described herein (e.g., PCR mutagenesis followed by insertion into a vector). The antibody is then expressed in a production cell line and screened for enhanced activity. Example screens include examining modulation in binding affinity to an antigen, stability, or effector function (e.g., ADCC, complement, or apoptosis). Exemplary regions to optimize the antibody include, without limitation, the Fc region, Fab region, variable region of the Fab region, constant region of the Fab region, variable domain of the heavy chain or light chain ($V_H$ or $V_L$), and specific complementarity-determining regions (CDRs) of $V_H$ or $V_L$.

Nucleic acid libraries synthesized by methods described herein may be expressed in various cells associated with a disease state. Cells associated with a disease state include cell lines, tissue samples, primary cells from a subject, cultured cells expanded from a subject, or cells in a model system. Exemplary model systems include, without limitation, plant and animal models of a disease state.

To identify a variant molecule associated with prevention, reduction or treatment of a disease state, a variant nucleic acid library described herein is expressed in a cell associated with a disease state, or one in which a cell a disease state can be induced. In some instances, an agent is used to induce a disease state in cells. Exemplary tools for disease state induction include, without limitation, a Cre/Lox recombination system, LPS inflammation induction, and streptozotocin to induce hypoglycemia. The cells associated with a disease state may be cells from a model system or cultured cells, as well as cells from a subject having a particular disease condition. Exemplary disease conditions include a bacterial, fungal, viral, autoimmune, or proliferative disorder (e.g., cancer). In some instances, the variant nucleic acid library is expressed in the model system, cell line, or primary cells derived from a subject, and screened for changes in at least one cellular activity. Exemplary cellular activities include, without limitation, proliferation, cycle progression, cell death, adhesion, migration, reproduction, cell signaling, energy production, oxygen utilization, metabolic activity, and aging, response to free radical damage, or any combination thereof Substrates Devices used as a surface for polynucleotide synthesis may be in the form of substrates which include, without limitation, homogenous array surfaces, patterned array surfaces, channels, beads, gels, and the like. Provided herein are substrates comprising a plurality of clusters, wherein each cluster comprises a plurality of loci that support the attachment and synthesis of polynucleotides. In some instances, substrates comprise a homogenous array surface. For example, the homogenous array surface is a homogenous plate. The term "locus" as used herein refers to a discrete region on a structure which provides support for polynucleotides encoding for a single predetermined sequence to extend from the surface. In some instances, a locus is on a two-dimensional surface, e.g., a substantially planar surface. In some instances, a locus is on a three-dimensional surface, e.g., a well, microwell, channel, or post. In some instances, a surface of a locus comprises a material that is actively functionalized to attach to at least one nucleotide for polynucleotide synthesis, or preferably, a population of identical nucleotides for synthesis of a population of polynucleotides. In some instances, polynucleotide refers to a population of polynucleotides encoding for the same nucleic acid sequence. In some cases, a surface of a substrate is inclusive of one or a plurality of surfaces of a substrate. The average error rates for polynucleotides synthesized within a library described here using the systems and methods provided are often less than 1 in 1000, less than about 1 in 2000, less than about 1 in 3000 or less often without error correction.

Provided herein are surfaces that support the parallel synthesis of a plurality of polynucleotides having different predetermined sequences at addressable locations on a common support. In some instances, a substrate provides support for the synthesis of more than 50, 100, 200, 400, 600, 800, 1000, 1200, 1400, 1600, 1800, 2,000; 5,000; 10,000; 20,000; 50,000; 100,000; 200,000; 300,000; 400,000; 500,000; 600,000; 700,000; 800,000; 900,000; 1,000,000; 1,200,000; 1,400,000; 1,600,000; 1,800,000; 2,000,000; 2,500,000; 3,000,000; 3,500,000; 4,000,000; 4,500,000; 5,000,000; 10,000,000 or more non-identical polynucleotides. In some cases, the surfaces provide support for the synthesis of more than 50, 100, 200, 400, 600, 800, 1000, 1200, 1400, 1600, 1800, 2,000; 5,000; 10,000; 20,000; 50,000; 100,000; 200, 000; 300,000; 400,000; 500,000; 600,000; 700,000; 800, 000; 900,000; 1,000,000; 1,200,000; 1,400,000; 1,600,000; 1,800,000; 2,000,000; 2,500,000; 3,000,000; 3,500,000; 4,000,000; 4,500,000; 5,000,000; 10,000,000 or more polynucleotides encoding for distinct sequences. In some instances, at least a portion of the polynucleotides have an identical sequence or are configured to be synthesized with an identical sequence. In some instances, the substrate provides a surface environment for the growth of polynucleotides having at least 80, 90, 100, 120, 150, 175, 200, 225, 250, 275, 300, 325, 350, 375, 400, 425, 450, 475, 500 bases or more.

Provided herein are methods for polynucleotide synthesis on distinct loci of a substrate, wherein each locus supports the synthesis of a population of polynucleotides. In some cases, each locus supports the synthesis of a population of polynucleotides having a different sequence than a population of polynucleotides grown on another locus. In some instances, each polynucleotide sequence is synthesized with 1, 2, 3, 4, 5, 6, 7, 8, 9 or more redundancy across different loci within the same cluster of loci on a surface for polynucleotide synthesis. In some instances, the loci of a substrate are located within a plurality of clusters. In some instances, a substrate comprises at least 10, 500, 1000, 2000, 3000, 4000, 5000, 6000, 7000, 8000, 9000, 10000, 11000, 12000, 13000, 14000, 15000, 20000, 30000, 40000, 50000 or more clusters. In some instances, a substrate comprises more than 2,000; 5,000; 10,000; 100,000; 200,000; 300,000; 400,000; 500,000; 600,000; 700,000; 800,000; 900,000; 1,000,000; 1,100,000; 1,200,000; 1,300,000; 1,400,000; 1,500,000; 1,600,000; 1,700,000; 1,800,000; 1,900,000; 2,000,000; 300,000; 400,000; 500,000; 600,000; 700,000; 800,000; 900,000; 1,000,000; 1,200,000; 1,400,000; 1,600, 000; 1,800,000; 2,000,000; 2,500,000; 3,000,000; 3,500, 000; 4,000,000; 4,500,000; 5,000,000; or 10,000,000 or more distinct loci. In some instances, a substrate comprises about 10,000 distinct loci. The amount of loci within a single cluster is varied in different instances. In some cases, each cluster includes 1, 2, 3, 4, 5, 6, 7, 8, 9, 10, 20, 30, 40, 50, 60, 70, 80, 90, 100, 120, 130, 150, 200, 300, 400, 500 or more loci. In some instances, each cluster includes about 50-500 loci. In some instances, each cluster includes about 100-200 loci. In some instances, each cluster includes about 100-150 loci. In some instances, each cluster includes about 109, 121, 130 or 137 loci. In some instances, each cluster includes about 19, 20, 61, 64 or more loci. Alternatively or in combination, polynucleotide synthesis occurs on a homogenous array surface.

In some instances, the number of distinct polynucleotides synthesized on a substrate is dependent on the number of distinct loci available in the substrate. In some instances, the density of loci within a cluster or surface of a substrate is at least or about 1, 10, 25, 50, 65, 75, 100, 130, 150, 175, 200, 300, 400, 500, 1,000 or more loci per $mm^2$. In some cases, a substrate comprises 10-500, 25-400, 50-500, 100-500, 150-500, 10-250, 50-250, 10-200, or 50-200 $mm^2$. In some instances, the distance between the centers of two adjacent loci within a cluster or surface is from about 10-500, from about 10-200, or from about 10-100 um. In some instances, the distance between two centers of adjacent loci is greater than about 10, 20, 30, 40, 50, 60, 70, 80, 90 or 100 um. In some instances, the distance between the centers of two adjacent loci is less than about 200, 150, 100, 80, 70, 60, 50, 40, 30, 20 or 10 um. In some instances, each locus has a width of about 0.5, 1, 2, 3, 4, 5, 6, 7, 8, 9, 10, 20, 30, 40, 50, 60, 70, 80, 90 or 100 um. In some cases, each locus has a width of about 0.5-100, 0.5-50, 10-75, or 0.5-50 um.

In some instances, the density of clusters within a substrate is at least or about 1 cluster per 100 mm$^2$, 1 cluster per 10 mm$^2$, 1 cluster per 5 mm$^2$, 1 cluster per 4 mm$^2$, 1 cluster per 3 mm$^2$, 1 cluster per 2 mm$^2$, 1 cluster per 1 mm$^2$, 2 clusters per 1 mm$^2$, 3 clusters per 1 mm$^2$, 4 clusters per 1 mm$^2$, 5 clusters per 1 mm$^2$, 10 clusters per 1 mm$^2$, 50 clusters per 1 mm$^2$ or more. In some instances, a substrate comprises from about 1 cluster per 10 mm$^2$ to about 10 clusters per 1 mm$^2$. In some instances, the distance between the centers of two adjacent clusters is at least or about 50, 100, 200, 500, 1000, 2000, or 5000 um. In some cases, the distance between the centers of two adjacent clusters is between about 50-100, 50-200, 50-300, 50-500, and 100-2000 um. In some cases, the distance between the centers of two adjacent clusters is between about 0.05-50, 0.05-10, 0.05-5, 0.05-4, 0.05-3, 0.05-2, 0.1-10, 0.2-10, 0.3-10, 0.4-10, 0.5-10, 0.5-5, or 0.5-2 mm. In some cases, each cluster has a cross section of about 0.5 to about 2, about 0.5 to about 1, or about 1 to about 2 mm. In some cases, each cluster has a cross section of about 0.5, 0.6, 0.7, 0.8, 0.9, 1, 1.1, 1.2, 1.3, 1.4, 1.5, 1.6, 1.7, 1.8, 1.9 or 2 mm. In some cases, each cluster has an interior cross section of about 0.5, 0.6, 0.7, 0.8, 0.9, 1, 1.1, 1.15, 1.2, 1.3, 1.4, 1.5, 1.6, 1.7, 1.8, 1.9 or 2 mm.

In some instances, a substrate is about the size of a standard 96 well plate, for example between about 100 and about 200 mm by between about 50 and about 150 mm. In some instances, a substrate has a diameter less than or equal to about 1000, 500, 450, 400, 300, 250, 200, 150, 100 or 50 mm. In some instances, the diameter of a substrate is between about 25-1000, 25-800, 25-600, 25-500, 25-400, 25-300, or 25-200 mm. In some instances, a substrate has a planar surface area of at least about 100; 200; 500; 1,000; 2,000; 5,000; 10,000; 12,000; 15,000; 20,000; 30,000; 40,000; 50,000 mm$^2$ or more. In some instances, the thickness of a substrate is between about 50-2000, 50-1000, 100-1000, 200-1000, or 250-1000 mm.

Surface Materials

Substrates, devices, and reactors provided herein are fabricated from any variety of materials suitable for the methods, compositions, and systems described herein. In certain instances, substrate materials are fabricated to exhibit a low level of nucleotide binding. In some instances, substrate materials are modified to generate distinct surfaces that exhibit a high level of nucleotide binding. In some instances, substrate materials are transparent to visible and/or UV light. In some instances, substrate materials are sufficiently conductive, e.g., are able to form uniform electric fields across all or a portion of a substrate. In some instances, conductive materials are connected to an electric ground. In some instances, the substrate is heat conductive or insulated. In some instances, the materials are chemical resistant and heat resistant to support chemical or biochemical reactions, for example polynucleotide synthesis reaction processes. In some instances, a substrate comprises flexible materials. For flexible materials, materials can include, without limitation: nylon, both modified and unmodified, nitrocellulose, polypropylene, and the like. In some instances, a substrate comprises rigid materials. For rigid materials, materials can include, without limitation: glass; fuse silica; silicon, plastics (for example polytetraflouroethylene, polypropylene, polystyrene, polycarbonate, and blends thereof, and the like); and metals (for example, gold, platinum, and the like). The substrate, solid support or reactors can be fabricated from a material selected from the group consisting of silicon, polystyrene, agarose, dextran, cellulosic polymers, polyacrylamides, polydimethylsiloxane (PDMS), and glass. The substrates/solid supports or the microstructures/reactors therein may be manufactured with a combination of materials listed herein or any other suitable material known in the art.

Surface Architecture

Provided herein are substrates for the methods, compositions, and systems described herein, wherein the substrates have a surface architecture suitable for the methods, compositions, and systems described herein. In some instances, a substrate comprises raised and/or lowered features. One benefit of having such features is an increase in surface area to support polynucleotide synthesis. In some instances, a substrate having raised and/or lowered features is referred to as a three-dimensional substrate. In some cases, a three-dimensional substrate comprises one or more channels. In some cases, one or more loci comprise a channel. In some cases, the channels are accessible to reagent deposition via a deposition device such as a material deposition device. In some cases, reagents and/or fluids collect in a larger well in fluid communication one or more channels. For example, a substrate comprises a plurality of channels corresponding to a plurality of loci with a cluster, and the plurality of channels are in fluid communication with one well of the cluster. In some methods, a library of polynucleotides is synthesized in a plurality of loci of a cluster.

Provided herein are substrates for the methods, compositions, and systems described herein, wherein the substrates are configured for polynucleotide synthesis. In some instances, the structure is configured to allow for controlled flow and mass transfer paths for polynucleotide synthesis on a surface. In some instances, the configuration of a substrate allows for the controlled and even distribution of mass transfer paths, chemical exposure times, and/or wash efficacy during polynucleotide synthesis. In some instances, the configuration of a substrate allows for increased sweep efficiency, for example by providing sufficient volume for a growing polynucleotide such that the excluded volume by the growing polynucleotide does not take up more than 50, 45, 40, 35, 30, 25, 20, 15, 14, 13, 12, 11, 10, 9, 8, 7, 6, 5, 4, 3, 2, 1%, or less of the initially available volume that is available or suitable for growing the polynucleotide. In some instances, a three-dimensional structure allows for managed flow of fluid to allow for the rapid exchange of chemical exposure.

Provided herein are substrates for the methods, compositions, and systems described herein, wherein the substrates comprise structures suitable for the methods, compositions, and systems described herein. In some instances, segregation is achieved by physical structure. In some instances, segregation is achieved by differential functionalization of the surface generating active and passive regions for polynucleotide synthesis. In some instances, differential functionalization is achieved by alternating the hydrophobicity across the substrate surface, thereby creating water contact angle effects that cause beading or wetting of the deposited reagents. Employing larger structures can decrease splashing and cross-contamination of distinct polynucleotide synthesis locations with reagents of the neighboring spots. In some cases, a device, such as a material deposition device, is used to deposit reagents to distinct polynucleotide synthesis locations. Substrates having three-dimensional features are configured in a manner that allows for the synthesis of a large number of polynucleotides (e.g., more than about 10,000) with a low error rate (e.g., less than about 1:500, 1:1000, 1:1500, 1:2,000, 1:3,000, 1:5,000, or 1:10,000). In some cases, a substrate comprises features with a density of about or greater than about 1, 5, 10, 20, 30, 40, 50, 60, 70, 80, 100, 110, 120, 130, 140, 150, 160, 170, 180, 190, 200, 300, 400 or 500 features per mm$^2$.

A well of a substrate may have the same or different width, height, and/or volume as another well of the substrate. A channel of a substrate may have the same or different width, height, and/or volume as another channel of the substrate. In some instances, the diameter of a cluster or the diameter of a well comprising a cluster, or both, is between about 0.05-50, 0.05-10, 0.05-5, 0.05-4, 0.05-3, 0.05-2, 0.05-1, 0.05-0.5, 0.05-0.1, 0.1-10, 0.2-10, 0.3-10, 0.4-10, 0.5-10, 0.5-5, or 0.5-2 mm. In some instances, the diameter of a cluster or well or both is less than or about 5, 4, 3, 2, 1, 0.5, 0.1, 0.09, 0.08, 0.07, 0.06, or 0.05 mm. In some instances, the diameter of a cluster or well or both is between about 1.0 and 1.3 mm. In some instances, the diameter of a cluster or well, or both is about 1.150 mm. In some instances, the diameter of a cluster or well, or both is about 0.08 mm. The diameter of a cluster refers to clusters within a two-dimensional or three-dimensional substrate.

In some instances, the height of a well is from about 20-1000, 50-1000, 100-1000, 200-1000, 300-1000, 400-1000, or 500-1000 um. In some cases, the height of a well is less than about 1000, 900, 800, 700, or 600 um.

In some instances, a substrate comprises a plurality of channels corresponding to a plurality of loci within a cluster, wherein the height or depth of a channel is 5-500, 5-400, 5-300, 5-200, 5-100, 5-50, or 10-50 um. In some cases, the height of a channel is less than 100, 80, 60, 40, or 20 um.

In some instances, the diameter of a channel, locus (e.g., in a substantially planar substrate) or both channel and locus (e.g., in a three-dimensional substrate wherein a locus corresponds to a channel) is from about 1-1000, 1-500, 1-200, 1-100, 5-100, or 10-100 um, for example, to about 90, 80, 70, 60, 50, 40, 30, 20 or 10 um. In some instances, the diameter of a channel, locus, or both channel and locus is less than about 100, 90, 80, 70, 60, 50, 40, 30, 20 or 10 um. In some instances, the distance between the center of two adjacent channels, loci, or channels and loci is from about 1-500, 1-200, 1-100, 5-200, 5-100, 5-50, or 5-30, for example, to about 20 um.

Surface Modifications

Provided herein are methods for polynucleotide synthesis on a surface, wherein the surface comprises various surface modifications. In some instances, the surface modifications are employed for the chemical and/or physical alteration of a surface by an additive or subtractive process to change one or more chemical and/or physical properties of a substrate surface or a selected site or region of a substrate surface. For example, surface modifications include, without limitation, (1) changing the wetting properties of a surface, (2) functionalizing a surface, i.e., providing, modifying or substituting surface functional groups, (3) defunctionalizing a surface, i.e., removing surface functional groups, (4) otherwise altering the chemical composition of a surface, e.g., through etching, (5) increasing or decreasing surface roughness, (6) providing a coating on a surface, e.g., a coating that exhibits wetting properties that are different from the wetting properties of the surface, and/or (7) depositing particulates on a surface.

In some cases, the addition of a chemical layer on top of a surface (referred to as adhesion promoter) facilitates structured patterning of loci on a surface of a substrate. Exemplary surfaces for application of adhesion promotion include, without limitation, glass, silicon, silicon dioxide and silicon nitride. In some cases, the adhesion promoter is a chemical with a high surface energy. In some instances, a second chemical layer is deposited on a surface of a substrate. In some cases, the second chemical layer has a low surface energy. In some cases, surface energy of a chemical layer coated on a surface supports localization of droplets on the surface. Depending on the patterning arrangement selected, the proximity of loci and/or area of fluid contact at the loci are alterable.

In some instances, a substrate surface, or resolved loci, onto which nucleic acids or other moieties are deposited, e.g., for polynucleotide synthesis, are smooth or substantially planar (e.g., two-dimensional) or have irregularities, such as raised or lowered features (e.g., three-dimensional features). In some instances, a substrate surface is modified with one or more different layers of compounds. Such modification layers of interest include, without limitation, inorganic and organic layers such as metals, metal oxides, polymers, small organic molecules, and the like.

In some instances, resolved loci of a substrate are functionalized with one or more moieties that increase and/or decrease surface energy. In some cases, a moiety is chemically inert. In some cases, a moiety is configured to support a desired chemical reaction, for example, one or more processes in a polynucleotide synthesis reaction. The surface energy, or hydrophobicity, of a surface is a factor for determining the affinity of a nucleotide to attach onto the surface. In some instances, a method for substrate functionalization comprises: (a) providing a substrate having a surface that comprises silicon dioxide; and (b) silanizing the surface using a suitable silanizing agent described herein or otherwise known in the art, for example, an organofunctional alkoxysilane molecule. Methods and functionalizing agents are described in U.S. Pat. No. 5,474,796, which is herein incorporated by reference in its entirety.

In some instances, a substrate surface is functionalized by contact with a derivatizing composition that contains a mixture of silanes, under reaction conditions effective to couple the silanes to the substrate surface, typically via reactive hydrophilic moieties present on the substrate surface. Silanization generally covers a surface through self-assembly with organofunctional alkoxysilane molecules. A variety of siloxane functionalizing reagents can further be used as currently known in the art, e.g., for lowering or increasing surface energy. The organofunctional alkoxysilanes are classified according to their organic functions.

Polynucleotide Synthesis

Methods of the current disclosure for polynucleotide synthesis may include processes involving phosphoramidite chemistry. In some instances, polynucleotide synthesis comprises coupling a base with phosphoramidite. Polynucleotide synthesis may comprise coupling a base by deposition of phosphoramidite under coupling conditions, wherein the same base is optionally deposited with phosphoramidite more than once, i.e., double coupling. Polynucleotide synthesis may comprise capping of unreacted sites. In some instances, capping is optional. Polynucleotide synthesis may also comprise oxidation or an oxidation step or oxidation steps. Polynucleotide synthesis may comprise deblocking, detritylation, and sulfurization. In some instances, polynucleotide synthesis comprises either oxidation or sulfurization. In some instances, between one or each step during a polynucleotide synthesis reaction, the device is washed, for example, using tetrazole or acetonitrile. Time frames for any one step in a phosphoramidite synthesis method may be less than about 2 min, 1 min, 50 sec, 40 sec, 30 sec, 20 sec and 10 sec.

Polynucleotide synthesis using a phosphoramidite method may comprise a subsequent addition of a phosphoramidite building block (e.g., nucleoside phosphoramidite) to a growing polynucleotide chain for the formation of a phosphite triester linkage. Phosphoramidite polynucleotide synthesis proceeds in the 3' to 5' direction. Phosphoramidite polynucleotide synthesis allows for the controlled addition of one nucleotide to a growing nucleic acid chain per synthesis cycle. In some instances, each synthesis cycle comprises a coupling step. Phosphoramidite coupling involves the formation of a phosphite triester linkage between an activated nucleoside phosphoramidite and a nucleoside bound to the substrate, for example, via a linker. In some instances, the nucleoside phosphoramidite is provided to the device activated. In some instances, the nucleoside phosphoramidite is provided to the device with an activator. In some instances, nucleoside phosphoramidites are provided to the device in a 1.5, 2, 3, 4, 5, 6, 7, 8, 9, 10, 11, 12, 13, 14, 15, 16, 17, 18, 19, 20, 25, 30, 35, 40, 50, 60, 70, 80, 90, 100-fold excess or more over the substrate-bound nucleosides. In some instances, the addition of nucleoside phosphoramidite is performed in an anhydrous environment, for example, in anhydrous acetonitrile. Following addition of a nucleoside phosphoramidite, the device is optionally washed. In some instances, the coupling step is repeated one or more additional times, optionally with a wash step between nucleoside phosphoramidite additions to the substrate. In some instances, a polynucleotide synthesis method used herein comprises 1, 2, 3 or more sequential coupling steps. Prior to coupling, in many cases, the nucleoside bound to the device is de-protected by removal of a protecting group, where the protecting group functions to prevent polymerization. A common protecting group is 4,4'-dimethoxytrityl (DMT).

Following coupling, phosphoramidite polynucleotide synthesis methods optionally comprise a capping step. In a capping step, the growing polynucleotide is treated with a capping agent. A capping step is useful to block unreacted substrate-bound 5'—OH groups after coupling from further chain elongation, preventing the formation of polynucleotides with internal base deletions. Further, phosphoramidites activated with 1H-tetrazole may react, to a small extent, with the 06 position of guanosine. Without being bound by theory, upon oxidation with $I_2$/water, this side product, possibly via O6-N7 migration, may undergo depurination. The apurinic sites may end up being cleaved in the course of the final deprotection of the polynucleotide thus reducing the yield of the full-length product. The O6 modifications may be removed by treatment with the capping reagent prior to oxidation with $I_2$/water. In some instances, inclusion of a capping step during polynucleotide synthesis decreases the error rate as compared to synthesis without capping. As an example, the capping step comprises treating the substrate-bound polynucleotide with a mixture of acetic anhydride and 1-methylimidazole. Following a capping step, the device is optionally washed.

In some instances, following addition of a nucleoside phosphoramidite, and optionally after capping and one or more wash steps, the device bound growing nucleic acid is oxidized. The oxidation step comprises a phosphite triester which is oxidized into a tetracoordinated phosphate triester, a protected precursor of the naturally occurring phosphate diester internucleoside linkage. In some instances, oxidation of the growing polynucleotide is achieved by treatment with iodine and water, optionally in the presence of a weak base (e.g., pyridine, lutidine, collidine). Oxidation may be carried out under anhydrous conditions using, e.g. tert-Butyl hydroperoxide or (1S)-(+)-(10-camphorsulfonyl)-oxaziridine (CSO). In some methods, a capping step is performed following oxidation. A second capping step allows for device drying, as residual water from oxidation that may persist can inhibit subsequent coupling. Following oxidation, the device and growing polynucleotide are optionally washed. In some instances, the step of oxidation is substituted with a sulfurization step to obtain polynucleotide phosphorothioates, wherein any capping steps can be performed after the sulfurization. Many reagents are capable of the efficient sulfur transfer, including but not limited to 3-(Dimethylaminomethylidene)amino)-3H-1,2,4-dithiazole-3-thione, DDTT, 3H-1,2-benzodithiol-3-one 1,1-dioxide, also known as Beaucage reagent, and N,N,N'N'-Tetraethylthiuram disulfide (TETD).

In order for a subsequent cycle of nucleoside incorporation to occur through coupling, the protected 5' end of the device bound growing polynucleotide is removed so that the primary hydroxyl group is reactive with a next nucleoside phosphoramidite. In some instances, the protecting group is DMT and deblocking occurs with trichloroacetic acid in dichloromethane. Conducting detritylation for an extended time or with stronger than recommended solutions of acids may lead to increased depurination of solid support-bound polynucleotide and thus reduces the yield of the desired full-length product. Methods and compositions of the disclosure described herein provide for controlled deblocking conditions limiting undesired depurination reactions. In some instances, the device bound polynucleotide is washed after deblocking. In some instances, efficient washing after deblocking contributes to synthesized polynucleotides having a low error rate.

Methods for the synthesis of polynucleotides typically involve an iterating sequence of the following steps: application of a protected monomer to an actively functionalized surface (e.g., locus) to link with either the activated surface, a linker or with a previously deprotected monomer; deprotection of the applied monomer so that it is reactive with a subsequently applied protected monomer; and application of another protected monomer for linking. One or more intermediate steps include oxidation or sulfurization. In some instances, one or more wash steps precede or follow one or all of the steps.

Methods for phosphoramidite-based polynucleotide synthesis comprise a series of chemical steps. In some instances, one or more steps of a synthesis method involve reagent cycling, where one or more steps of the method comprise application to the device of a reagent useful for the step. For example, reagents are cycled by a series of liquid deposition and vacuum drying steps. For substrates comprising three-dimensional features such as wells, microwells, channels and the like, reagents are optionally passed through one or more regions of the device via the wells and/or channels.

Methods and systems described herein relate to polynucleotide synthesis devices for the synthesis of polynucleotides. The synthesis may be in parallel. For example, at least or about at least 2, 3, 4, 5, 6, 7, 8, 9, 10, 11, 12, 13, 14, 15, 16, 17, 18, 19, 20, 21, 22, 23, 24, 25, 30, 35, 40, 45, 50, 100, 150, 200, 250, 300, 350, 400, 450, 500, 550, 600, 650, 700, 750, 800, 850, 900, 1000, 10000, 50000, 75000, 100000 or more polynucleotides can be synthesized in parallel. The total number polynucleotides that may be synthesized in parallel may be from 2-100000, 3-50000, 4-10000, 5-1000, 6-900, 7-850, 8-800, 9-750, 10-700, 11-650, 12-600, 13-550, 14-500, 15-450, 16-400, 17-350, 18-300, 19-250, 20-200, 21-150,22-100, 23-50, 24-45, 25-40, 30-35. Those of skill in the art appreciate that the total number of polynucleotides synthesized in parallel may fall within any range bound by any of these values, for example 25-100. The total number of polynucleotides synthesized in parallel may fall within any range defined by any of the values serving as endpoints of the range. Total molar mass of polynucleotides synthesized within the device or the molar mass of each of the polynucleotides may be at least or at least about 10, 20, 30, 40, 50, 100, 250, 500, 750, 1000, 2000, 3000, 4000, 5000, 6000, 7000, 8000, 9000, 10000, 25000, 50000, 75000, 100000 picomoles, or more. The length of each of the polynucleotides or average length of the polynucleotides within the device may be at least or about at least 10, 15, 20, 25, 30, 35, 40, 45, 50, 100, 150, 200, 300, 400, 500 nucleotides, or more. The length of each of the polynucleotides or average length of the polynucleotides within the device may be at most or about at most 500, 400, 300, 200, 150, 100, 50, 45, 35, 30, 25, 20, 19, 18, 17, 16, 15, 14, 13, 12, 11, 10 nucleotides, or less. The length of each of the polynucleotides or average length of the polynucleotides within the device may fall from 10-500, 9-400, 11-300, 12-200, 13-150, 14-100, 15-50, 16-45, 17-40, 18-35, 19-25. Those of skill in the art appreciate that the length of each of the polynucleotides or average length of the polynucleotides within the device may fall within any range bound by any of these values, for example 100-300. The length of each of the polynucleotides or average length of the polynucleotides within the device may fall within any range defined by any of the values serving as endpoints of the range.

Methods for polynucleotide synthesis on a surface provided herein allow for synthesis at a fast rate. As an example, at least 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 70, 80, 90, 100, 125, 150, 175, 200 nucleotides per hour, or more are synthesized. Nucleotides include adenine, guanine, thymine, cytosine, uridine building blocks, or analogs/modified versions thereof. In some instances, libraries of polynucleotides are synthesized in parallel on substrate. For example, a device comprising about or at least about 100; 1,000; 10,000; 30,000; 75,000; 100,000; 1,000,000; 2,000,000; 3,000,000; 4,000,000; or 5,000,000 resolved loci is able to support the synthesis of at least the same number of distinct polynucleotides, wherein polynucleotide encoding a distinct sequence is synthesized on a resolved locus. In some instances, a library of polynucleotides is synthesized on a device with low error rates described herein in less than about three months, two months, one month, three weeks, 15, 14, 13, 12, 11, 10, 9, 8, 7, 6, 5, 4, 3, 2 days, 24 hours, or less. In some instances, larger nucleic acids assembled from a polynucleotide library synthesized with low error rate using the substrates and methods described herein are prepared in less than about three months, two months, one month, three weeks, 15, 14, 13, 12, 11, 10, 9, 8, 7, 6, 5, 4, 3, 2 days, 24 hours, or less.

In some instances, methods described herein provide for generation of a library of nucleic acids comprising variant nucleic acids differing at a plurality of codon sites. In some instances, a nucleic acid may have 1 site, 2 sites, 3 sites, 4 sites, 5 sites, 6 sites, 7 sites, 8 sites, 9 sites, 10 sites, 11 sites, 12 sites, 13 sites, 14 sites, 15 sites, 16 sites, 17 sites 18 sites, 19 sites, 20 sites, 30 sites, 40 sites, 50 sites, or more of variant codon sites.

In some instances, the one or more sites of variant codon sites may be adjacent. In some instances, the one or more sites of variant codon sites may not be adjacent but are separated by 1, 2, 3, 4, 5, 6, 7, 8, 9, 10, or more codons.

In some instances, a nucleic acid may comprise multiple sites of variant codon sites, wherein all the variant codon sites are adjacent to one another, forming a stretch of variant codon sites. In some instances, a nucleic acid may comprise multiple sites of variant codon sites, wherein none the variant codon sites are adjacent to one another. In some instances, a nucleic acid may comprise multiple sites of variant codon sites, wherein some the variant codon sites are adjacent to one another, forming a stretch of variant codon sites, and some of the variant codon sites are not adjacent to one another.

Figure 3:
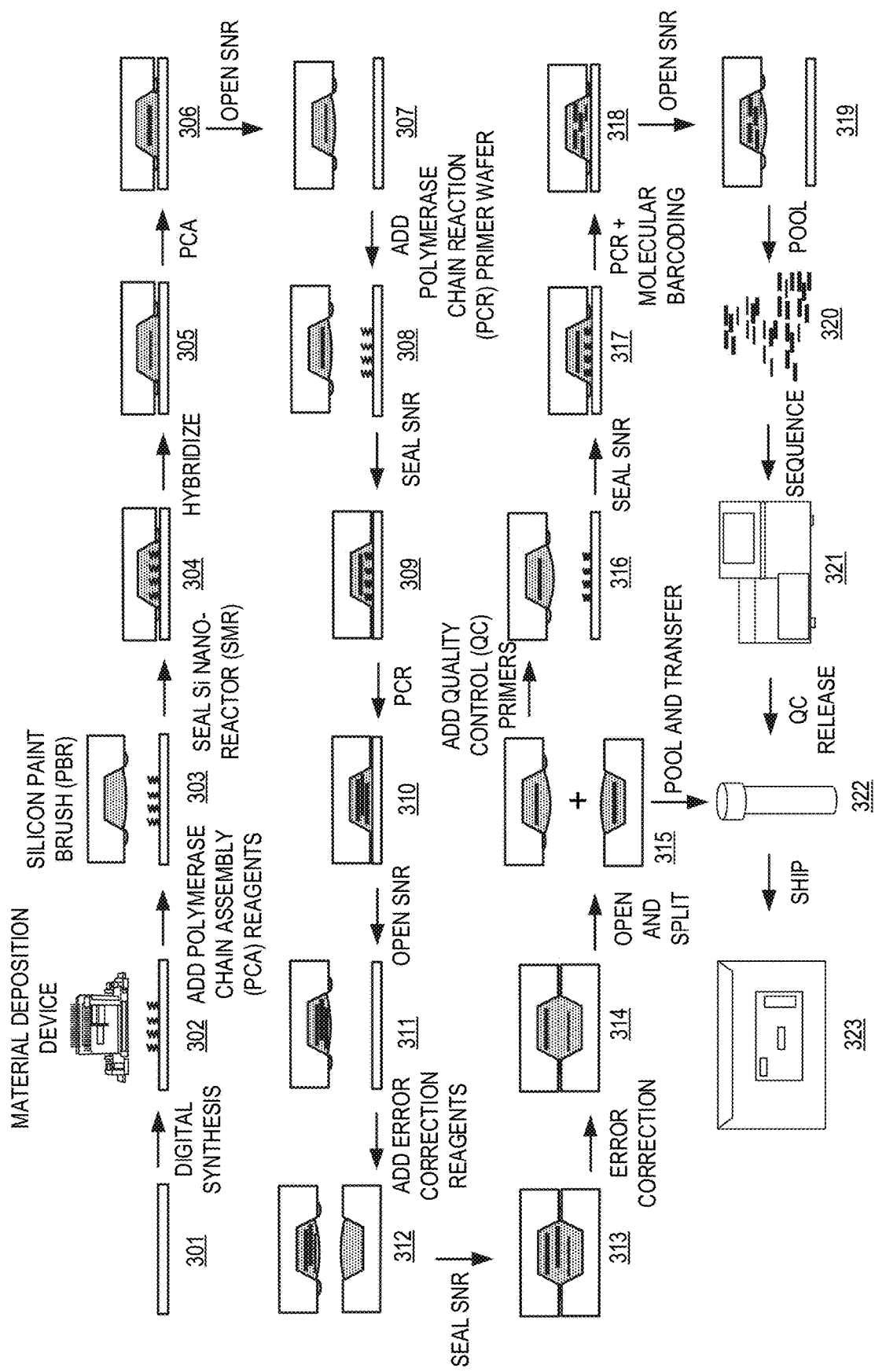
FIG. 3 presents a diagram of steps demonstrating an exemplary process workflow for gene synthesis as disclosed herein.

Referring to the Figures, FIG. 3 illustrates an exemplary process workflow for synthesis of nucleic acids (e.g., genes) from shorter nucleic acids. The workflow is divided generally into phases: (1) de novo synthesis of a single stranded nucleic acid library, (2) joining nucleic acids to form larger fragments, (3) error correction, (4) quality control, and (5) shipment. Prior to de novo synthesis, an intended nucleic acid sequence or group of nucleic acid sequences is preselected. For example, a group of genes is preselected for generation.

Once large nucleic acids for generation are selected, a predetermined library of nucleic acids is designed for de novo synthesis. Various suitable methods are known for generating high density polynucleotide arrays. In the workflow example, a device surface layer is provided. In the example, chemistry of the surface is altered in order to improve the polynucleotide synthesis process. Areas of low surface energy are generated to repel liquid while areas of high surface energy are generated to attract liquids. The surface itself may be in the form of a planar surface or contain variations in shape, such as protrusions or microwells which increase surface area. In the workflow example, high surface energy molecules selected serve a dual function of supporting DNA chemistry, as disclosed in International Patent Application Publication WO/2015/021080, which is herein incorporated by reference in its entirety.

In situ preparation of polynucleotide arrays is generated on a solid support 301 and utilizes single nucleotide extension process to extend multiple oligomers in parallel. A deposition device, such as a material deposition device, is designed to release reagents in a step-wise fashion such that multiple polynucleotides extend, in parallel, one residue at a time to generate oligomers with a predetermined nucleic acid sequence 302. In some instances, polynucleotides are cleaved from the surface at this stage. Cleavage includes gas cleavage, e.g., with ammonia or methylamine.

The generated polynucleotide libraries are placed in a reaction chamber. In this exemplary workflow, the reaction chamber (also referred to as "nanoreactor") is a silicon coated well, containing PCR reagents and lowered onto the polynucleotide library 303. Prior to or after the sealing 304 of the polynucleotides, a reagent is added to release the polynucleotides from the substrate. In the exemplary workflow, the polynucleotides are released subsequent to sealing of the nanoreactor 305. Once released, fragments of single stranded polynucleotides hybridize in order to span an entire long-range sequence of DNA. Partial hybridization 305 is possible because each synthesized polynucleotide is designed to have a small portion overlapping with at least one other polynucleotide in the pool.

After hybridization, a PCA reaction is commenced. During the polymerase cycles, the polynucleotides anneal to complementary fragments and gaps are filled in by a polymerase. Each cycle increases the length of various fragments randomly depending on which polynucleotides find each other. Complementarity amongst the fragments allows for formation of a complete large span of double stranded DNA 306.

After PCA is complete, the nanoreactor is separated from the device 307 and positioned for interaction with a device having primers for PCR 308. After sealing, the nanoreactor is subject to PCR 309 and the larger nucleic acids are amplified. After PCR 310, the nanochamber is opened 311, error correction reagents are added 312, the chamber is sealed 313 and an error correction reaction occurs to remove mismatched base pairs and/or strands with poor complementarity from the double stranded PCR amplification products 314. The nanoreactor is opened and separated 315. Error corrected product is next subject to additional processing steps, such as PCR and molecular bar coding, and then packaged 322 for shipment 323.

In some instances, quality control measures are taken. After error correction, quality control steps include for example interaction with a wafer having sequencing primers for amplification of the error corrected product 316, sealing the wafer to a chamber containing error corrected amplification product 317, and performing an additional round of amplification 318. The nanoreactor is opened 319 and the products are pooled 320 and sequenced 321. After an acceptable quality control determination is made, the packaged product 322 is approved for shipment 323.

In some instances, a nucleic acid generated by a workflow such as that in FIG. 3 is subject to mutagenesis using overlapping primers disclosed herein. In some instances, a library of primers is generated by in situ preparation on a solid support 301 and utilize single nucleotide extension process to extend multiple oligomers in parallel. A deposition device, such as a material deposition device, is designed to release reagents in a step wise fashion such that multiple polynucleotides extend, in parallel, one residue at a time to generate oligomers with a predetermined nucleic acid sequence 302.

Computer Systems

Any of the systems described herein, may be operably linked to a computer and may be automated through a computer either locally or remotely. In various instances, the methods and systems of the disclosure may further comprise software programs on computer systems and use thereof. Accordingly, computerized control for the synchronization of the dispense/vacuum/refill functions such as orchestrating and synchronizing the material deposition device movement, dispense action and vacuum actuation are within the bounds of the disclosure. The computer systems may be programmed to interface between the user specified base sequence and the position of a material deposition device to deliver the correct reagents to specified regions of the substrate.

Figure 4:
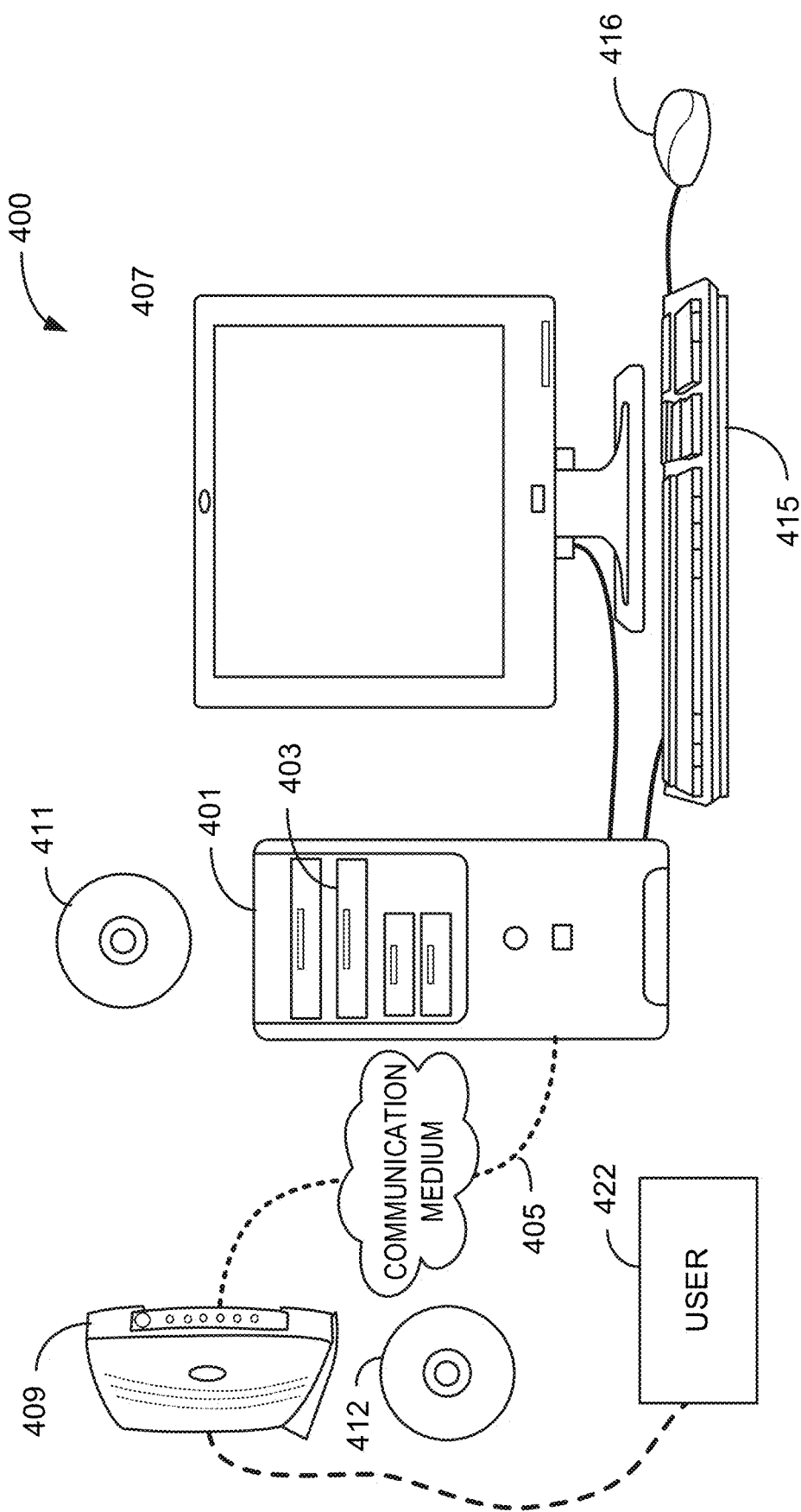
FIG. 4 illustrates an example of a computer system.

The computer system 400 illustrated in FIG. 4 may be understood as a logical apparatus that can read instructions from media 411 and/or a network port 405, which can optionally be connected to server 409 having fixed media 412. The system, such as shown in FIG. 4 can include a CPU 401, disk drives 403, optional input devices such as keyboard 415 and/or mouse 416 and optional monitor 407. Data communication can be achieved through the indicated communication medium to a server at a local or a remote location. The communication medium can include any means of transmitting and/or receiving data. For example, the communication medium can be a network connection, a wireless connection or an internet connection. Such a connection can provide for communication over the World Wide Web. It is envisioned that data relating to the present disclosure can be transmitted over such networks or connections for reception and/or review by a party 422 as illustrated in FIG. 4.

Figure 5:
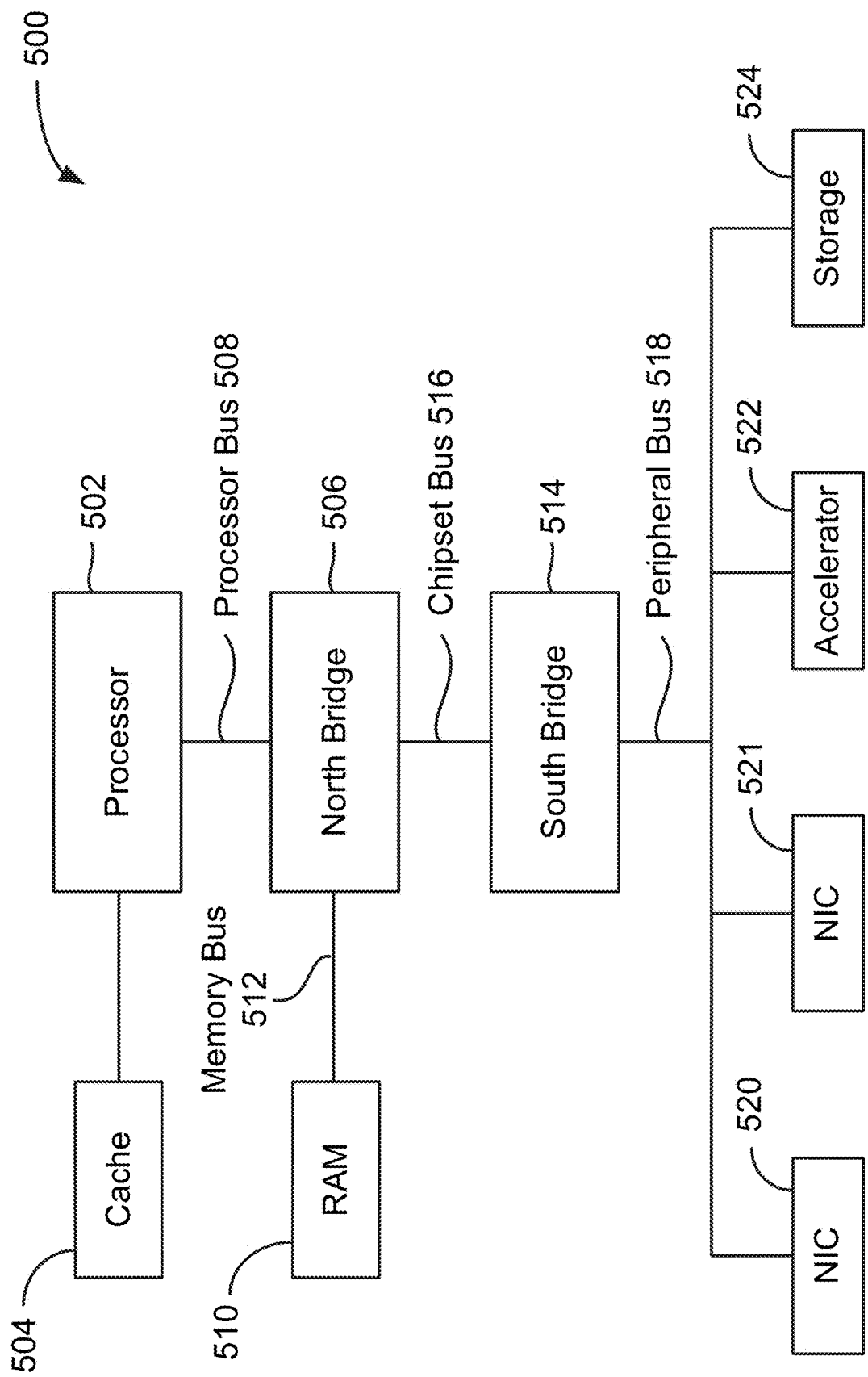
FIG. 5 is a block diagram illustrating an architecture of a computer system.

FIG. 5 is a block diagram illustrating a first example architecture of a computer system 500 that can be used in connection with example instances of the present disclosure. As depicted in FIG. 5, the example computer system can include a processor 502 for processing instructions. Non-limiting examples of processors include: Intel Xeon™ processor, AMD Opteron™ processor, Samsung 32-bit RISC ARM 1176JZ(F)-S v1.0™ processor, ARM Cortex-A8 Samsung S5PC100™ processor, ARM Cortex-A8 Apple A4™ processor, Marvell PXA 930™ processor, or a functionally-equivalent processor. Multiple threads of execution can be used for parallel processing. In some instances, multiple processors or processors with multiple cores can also be used, whether in a single computer system, in a cluster, or distributed across systems over a network comprising a plurality of computers, cell phones, and/or personal data assistant devices.

As illustrated in FIG. 5, a high-speed cache 504 can be connected to, or incorporated in, the processor 502 to provide a high speed memory for instructions or data that have been recently, or are frequently, used by the processor 502. The processor 502 is connected to a north bridge 506 by a processor bus 508. The north bridge 506 is connected to random access memory (RAM) 510 by a memory bus 512 and manages access to the RAM 510 by the processor 502. The north bridge 506 is also connected to a south bridge 514 by a chipset bus 516. The south bridge 514 is, in turn, connected to a peripheral bus 518. The peripheral bus can be, for example, PCI, PCI-X, PCI Express, or other peripheral bus. The north bridge and south bridge are often referred to as a processor chipset and manage data transfer between the processor, RAM, and peripheral components on the peripheral bus 518. In some alternative architectures, the functionality of the north bridge can be incorporated into the processor instead of using a separate north bridge chip. In some instances, system 500 can include an accelerator card 522 attached to the peripheral bus 518. The accelerator can include field programmable gate arrays (FPGAs) or other hardware for accelerating certain processing. For example, an accelerator can be used for adaptive data restructuring or to evaluate algebraic expressions used in extended set processing.

Software and data are stored in external storage 524 and can be loaded into RAM 510 and/or cache 504 for use by the processor. The system 500 includes an operating system for managing system resources; non-limiting examples of operating systems include: Linux, Windows™, MACOS™, BlackBerry OS™, iOS™, and other functionally-equivalent operating systems, as well as application software running on top of the operating system for managing data storage and optimization in accordance with example instances of the present disclosure. In this example, system 500 also includes network interface cards (NICs) 520 and 521 connected to the peripheral bus for providing network interfaces to external storage, such as Network Attached Storage (NAS) and other computer systems that can be used for distributed parallel processing.

Figure 6:
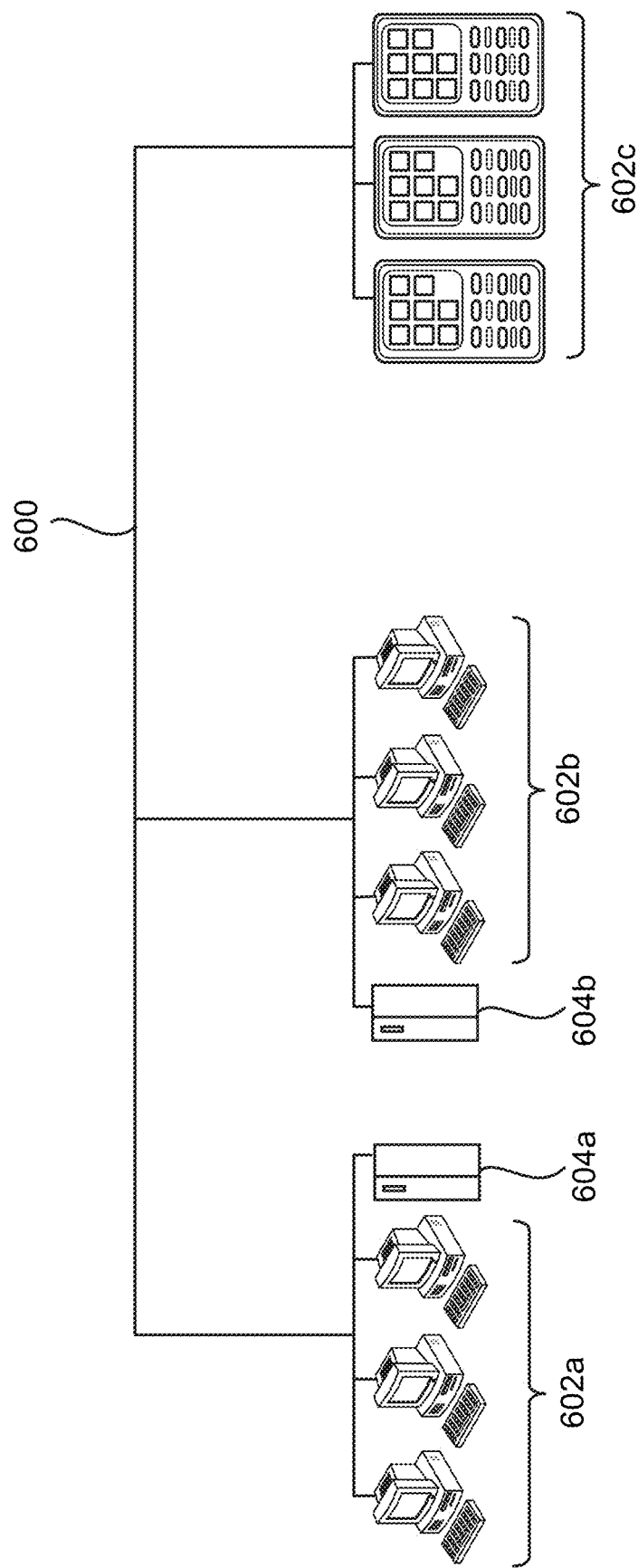
FIG. 6 is a diagram demonstrating a network configured to incorporate a plurality of computer systems, a plurality of cell phones and personal data assistants, and Network Attached Storage (NAS).

FIG. 6 is a diagram showing a network 600 with a plurality of computer systems 602a, and 602b, a plurality of cell phones and personal data assistants 602c, and Network Attached Storage (NAS) 604a, and 604b. In example instances, systems 602a, 602b, and 602c can manage data storage and optimize data access for data stored in Network Attached Storage (NAS) 604a and 604b. A mathematical model can be used for the data and be evaluated using distributed parallel processing across computer systems 602a, and 602b, and cell phone and personal data assistant systems 602c. Computer systems 602a, and 602b, and cell phone and personal data assistant systems 602c can also provide parallel processing for adaptive data restructuring of the data stored in Network Attached Storage (NAS) 604a and 604b. FIG. 6 illustrates an example only, and a wide variety of other computer architectures and systems can be used in conjunction with the various instances of the present disclosure. For example, a blade server can be used to provide parallel processing. Processor blades can be connected through a back plane to provide parallel processing. Storage can also be connected to the back plane or as Network Attached Storage (NAS) through a separate network interface. In some example instances, processors can maintain separate memory spaces and transmit data through network interfaces, back plane or other connectors for parallel processing by other processors. In other instances, some or all of the processors can use a shared virtual address memory space.

Figure 7:
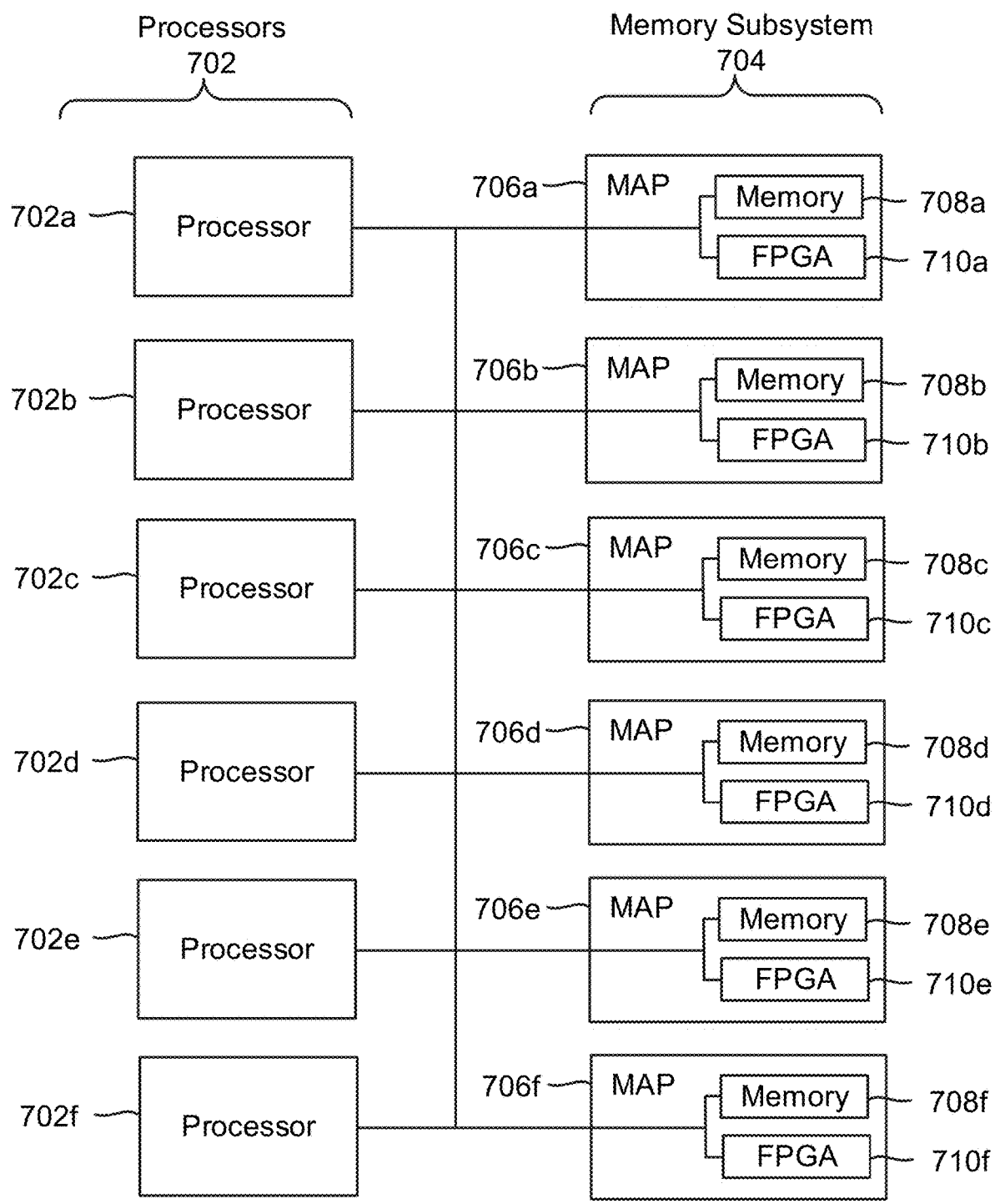
FIG. 7 is a block diagram of a multiprocessor computer system using a shared virtual address memory space.
Figure 8A:
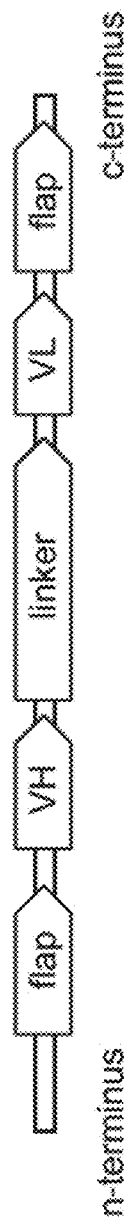
FIG. 8A depicts a schematic of an immunoglobulin comprising a VH domain attached to a VL domain using a linker.
Figure 8B:
FIG. 8B depicts a schematic of a full-domain architecture of an immunoglobulin comprising a VH domain attached to a VL domain using a linker, a leader sequence, and pIII sequence.
Figure 8C:
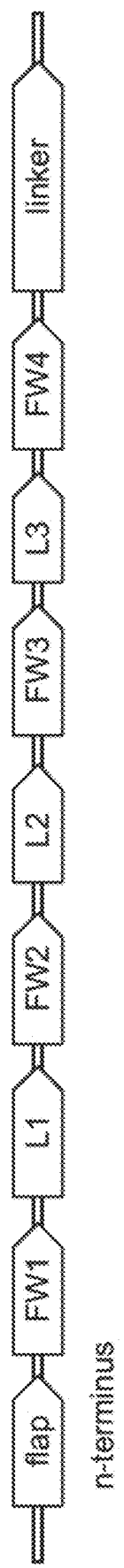
FIG. 8C depicts a schematic of four framework elements (FW1, FW2, FW3, FW4) and the variable 3 CDR (L1, L2, L3) elements for a VL or VH domain.

FIG. 7 is a block diagram of a multiprocessor computer system 700 using a shared virtual address memory space in accordance with an example instance. The system includes a plurality of processors 702a-f that can access a shared memory subsystem 704. The system incorporates a plurality of programmable hardware memory algorithm processors (MAPs) 706a-f in the memory subsystem 704. Each MAP 706a-f can comprise a memory 708a-f and one or more field programmable gate arrays (FPGAs) 710a-f. The MAP provides a configurable functional unit and particular algorithms or portions of algorithms can be provided to the FPGAs 710a-f for processing in close coordination with a respective processor. For example, the MAPs can be used to evaluate algebraic expressions regarding the data model and to perform adaptive data restructuring in example instances. In this example, each MAP is globally accessible by all of the processors for these purposes. In one configuration, each MAP can use Direct Memory Access (DMA) to access an associated memory 708a-f, allowing it to execute tasks independently of, and asynchronously from the respective microprocessor 702a-f. In this configuration, a MAP can feed results directly to another MAP for pipelining and parallel execution of algorithms.

The above computer architectures and systems are examples only, and a wide variety of other computer, cell phone, and personal data assistant architectures and systems can be used in connection with example instances, including systems using any combination of general processors, co-processors, FPGAs and other programmable logic devices, system on chips (SOCs), application specific integrated circuits (ASICs), and other processing and logic elements. In some instances, all or part of the computer system can be implemented in software or hardware. Any variety of data storage media can be used in connection with example instances, including random access memory, hard drives, flash memory, tape drives, disk arrays, Network Attached Storage (NAS) and other local or distributed data storage devices and systems.

In example instances, the computer system can be implemented using software modules executing on any of the above or other computer architectures and systems. In other instances, the functions of the system can be implemented partially or completely in firmware, programmable logic devices such as field programmable gate arrays (FPGAs) as referenced in FIG. 5, system on chips (SOCs), application specific integrated circuits (ASICs), or other processing and logic elements. For example, the Set Processor and Optimizer can be implemented with hardware acceleration through the use of a hardware accelerator card, such as accelerator card 522 illustrated in FIG. 5.

The following examples are set forth to illustrate more clearly the principle and practice of embodiments disclosed herein to those skilled in the art and are not to be construed as limiting the scope of any claimed embodiments. Unless otherwise stated, all parts and percentages are on a weight basis.

EXAMPLES

The following examples are given for the purpose of illustrating various embodiments of the disclosure and are not meant to limit the present disclosure in any fashion. The present examples, along with the methods described herein are presently representative of preferred embodiments, are exemplary, and are not intended as limitations on the scope of the disclosure. Changes therein and other uses which are encompassed within the spirit of the disclosure as defined by the scope of the claims will occur to those skilled in the art.

Example 1: Functionalization of a Device Surface

A device was functionalized to support the attachment and synthesis of a library of polynucleotides. The device surface was first wet cleaned using a piranha solution comprising 90% $H_2SO_4$ and 10% $H_2O_2$ for 20 minutes. The device was rinsed in several beakers with DI water, held under a DI water gooseneck faucet for 5 min, and dried with $N_2$. The device was subsequently soaked in $NH_4OH$ (1:100; 3 mL:300 mL) for 5 min, rinsed with DI water using a handgun, soaked in three successive beakers with DI water for 1 min each, and then rinsed again with DI water using the handgun. The device was then plasma cleaned by exposing the device surface to $O_2$. A SAMCO PC-300 instrument was used to plasma etch $O_2$ at 250 watts for 1 min in downstream mode.

The cleaned device surface was actively functionalized with a solution comprising N-(3-triethoxysilylpropyl)-4-hydroxybutyramide using a YES-1224P vapor deposition oven system with the following parameters: 0.5 to 1 torr, 60 min, 70° C., 135° C. vaporizer. The device surface was resist coated using a Brewer Science 200× spin coater. SPR™ 3612 photoresist was spin coated on the device at 2500 rpm for 40 sec. The device was pre-baked for 30 min at 90° C. on a Brewer hot plate. The device was subjected to photolithography using a Karl Suss MA6 mask aligner instrument. The device was exposed for 2.2 sec and developed for 1 min in MSF 26A. Remaining developer was rinsed with the handgun and the device soaked in water for 5 min. The device was baked for 30 min at 100° C. in the oven, followed by visual inspection for lithography defects using a Nikon L200. A descum process was used to remove residual resist using the SAMCO PC-300 instrument to $O_2$ plasma etch at 250 watts for 1 min.

The device surface was passively functionalized with a 100 µL, solution of perfluorooctyltrichlorosilane mixed with 10 µL, light mineral oil. The device was placed in a chamber, pumped for 10 min, and then the valve was closed to the pump and left to stand for 10 min. The chamber was vented to air. The device was resist stripped by performing two soaks for 5 min in 500 mL NMP at 70° C. with ultrasonication at maximum power (9 on Crest system). The device was then soaked for 5 min in 500 mL isopropanol at room temperature with ultrasonication at maximum power. The device was dipped in 300 mL of 200 proof ethanol and blown dry with $N_2$. The functionalized surface was activated to serve as a support for polynucleotide synthesis.

Example 2: Synthesis of a 50-Mer Sequence on an Oligonucleotide Synthesis Device A two-dimensional oligonucleotide synthesis device was assembled into a flowcell, which was connected to a flowcell (Applied Biosystems (ABI394 DNA Synthesizer"). The two-dimensional oligonucleotide synthesis device was uniformly functionalized with N-(3-TRIETHOXYSILYLPROPYL)-4-HYDROXYBUTYRAMIDE (Gelest) which was used to synthesize an exemplary polynucleotide of 50 bp ("50-mer polynucleotide") using polynucleotide synthesis methods described herein.

The sequence of the 50-mer was as described in SEQ ID NO: 393. 5'AGACAATCAACCATTTGGGGTGGACA GCCTTGACCTCTAGACTTCGGCAT##TTTTTTT TTT3' (SEQ ID NO.: 393), where #denotes Thymidine-succinyl hexamide CED phosphoramidite (CLP-2244 from ChemGenes), which is a cleavable linker enabling the release of oligos from the surface during deprotection.

The synthesis was done using standard DNA synthesis chemistry (coupling, capping, oxidation, and deblocking) according to the protocol in Table 1 and an ABI synthesizer.

TABLE 1

Synthesis protocols

| General DNA Synthesis Process Name | Process Step | Time (sec) |
|---|---|---|
| WASH (Acetonitrile Wash Flow) | Acetonitrile System Flush | 4 |
| | Acetonitrile to Flowcell | 23 |
| | N2 System Flush | 4 |
| | Acetonitrile System Flush | 4 |
| DNA BASE ADDITION (Phosphoramidite + Activator Flow) | Activator Manifold Flush | 2 |
| | Activator to Flowcell | 6 |
| | Activator + Phosphoramidite to Flowcell | 6 |
| | Activator to Flowcell | 0.5 |
| | Activator + Phosphoramidite to Flowcell | 5 |
| | Activator to Flowcell | 0.5 |
| | Activator + Phosphoramidite to Flowcell | 5 |
| | Activator to Flowcell | 0.5 |
| | Activator + Phosphoramidite to Flowcell | 5 |
| | Incubate for 25 sec | 25 |
| WASH (Acetonitrile Wash Flow) | Acetonitrile System Flush | 4 |
| | Acetonitrile to Flowcell | 15 |
| | N2 System Flush | 4 |
| | Acetonitrile System Flush | 4 |
| DNA BASE ADDITION (Phosphoramidite + Activator Flow) | Activator Manifold Flush | 2 |
| | Activator to Flowcell | 5 |
| | Activator + Phosphoramidite to Flowcell | 18 |
| | Incubate for 25 sec | 25 |
| WASH (Acetonitrile Wash Flow) | Acetonitrile System Flush | 4 |
| | Acetonitrile to Flowcell | 15 |
| | N2 System Flush | 4 |
| | Acetonitrile System Flush | 4 |
| CAPPING (CapA + B, 1:1, Flow) | CapA + B to Flowcell | 15 |
| WASH (Acetonitrile Wash Flow) | Acetonitrile System Flush | 4 |
| | Acetonitrile to Flowcell | 15 |
| | Acetonitrile System Flush | 4 |
| OXIDATION (Oxidizer Flow) | Oxidizer to Flowcell | 18 |

TABLE 1-continued

Synthesis protocols

| General DNA Synthesis Process Name | Process Step | Time (sec) |
|---|---|---|
| WASH (Acetonitrile Wash Flow) | Acetonitrile System Flush | 4 |
| | N2 System Flush | 4 |
| | Acetonitrile System Flush | 4 |
| | Acetonitrile to Flowcell | 15 |
| | Acetonitrile System Flush | 4 |
| | Acetonitrile to Flowcell | 15 |
| | N2 System Flush | 4 |
| | Acetonitrile System Flush | 4 |
| | Acetonitrile to Flowcell | 23 |
| | N2 System Flush | 4 |
| | Acetonitrile System Flush | 4 |
| DEBLOCKING (Deblock Flow) | Deblock to Flowcell | 36 |
| WASH (Acetonitrile Wash Flow) | Acetonitrile System Flush | 4 |
| | N2 System Flush | 4 |
| | Acetonitrile System Flush | 4 |
| | Acetonitrile to Flowcell | 18 |
| | N2 System Flush | 4.13 |
| | Acetonitrile System Flush | 4.13 |
| | Acetonitrile to Flowcell | 15 |

The phosphoramidite/activator combination was delivered similarly to the delivery of bulk reagents through the flowcell. No drying steps were performed as the environment stays "wet" with reagent the entire time.

The flow restrictor was removed from the ABI 394 synthesizer to enable faster flow. Without flow restrictor, flow rates for amidites (0.1M in ACN), Activator, (0.25M Benzoylthiotetrazole ("BTT"; 30-3070-xx from GlenResearch) in ACN), and Ox (0.02M I2 in 20% pyridine, 10% water, and 70% THF) were roughly ~100 uL/sec, for acetonitrile ("ACN") and capping reagents (1:1 mix of CapA and CapB, wherein CapA is acetic anhydride in THF/Pyridine and CapB is 16% 1-methylimidizole in THF), roughly ~200 uL/sec, and for Deblock (3% dichloroacetic acid in toluene), roughly ~300 uL/sec (compared to ~50 uL/sec for all reagents with flow restrictor). The time to completely push out Oxidizer was observed, the timing for chemical flow times was adjusted accordingly and an extra ACN wash was introduced between different chemicals. After polynucleotide synthesis, the chip was deprotected in gaseous ammonia overnight at 75 psi. Five drops of water were applied to the surface to recover polynucleotides. The recovered polynucleotides were then analyzed on a BioAnalyzer small RNA chip.

Example 3: Synthesis of a 100-Mer Sequence on an Oligonucleotide Synthesis Device The same process as described in Example 2 for the synthesis of the 50-mer sequence was used for the synthesis of a 100-mer polynucleotide ("100-mer polynucleotide"; 5' CGGGATCCTTATCGTCATCGTCGTACAGATCCCG ACCCATTTGCTGTCCACCAGTCATG CTAGCCATAC-CATGATGATGATGATGATGAGAACCCCGCAT ##TTTTTTTTTT3', where #denotes Thymidine-succinyl hexamide CED phosphoramidite (CLP-2244 from ChemGenes); SEQ ID NO.: 2161) on two different silicon chips, the first one uniformly functionalized with N-(3-TRIETHOXYSILYLPROPYL)-4-HYDROXYBUTYRAMIDE and the second one functionalized with 5/95 mix of 11-acetoxyundecyltriethoxysilane and n-decyltriethoxysilane, and the polynucleotides extracted from the surface were analyzed on a BioAnalyzer instrument.

All ten samples from the two chips were further PCR amplified using a forward (5'ATGCGGGGTTCTCATCATC3'; SEQ ID NO.: 2162) and a reverse (5'CGGGATCCTTATCGTCATCG3; SEQ ID NO.: 2163) primer in a 50 uL PCR mix (25 uL NEB Q5 mastermix, 2.5 uL 10 uM Forward primer, 2.5 uL 10 uM Reverse primer, luL polynucleotide extracted from the surface, and water up to 50 uL) using the following thermalcycling program:

98° C., 30 sec

98° C., 10 sec; 63° C., 10 sec; 72° C., 10 sec; repeat 12 cycles

72° C., 2 min

The PCR products were also run on a BioAnalyzer, demonstrating sharp peaks at the 100-mer position. Next, the PCR amplified samples were cloned, and Sanger sequenced. Table 2 summarizes the results from the Sanger sequencing for samples taken from spots 1-5 from chip 1 and for samples taken from spots 6-10 from chip 2.

TABLE 2

Sequencing results

| Spot | Error rate | Cycle efficiency |
|---|---|---|
| 1 | 1/763 bp | 99.87% |
| 2 | 1/824 bp | 99.88% |
| 3 | 1/780 bp | 99.87% |
| 4 | 1/429 bp | 99.77% |
| 5 | 1/1525 bp | 99.93% |
| 6 | 1/1615 bp | 99.94% |
| 7 | 1/531 bp | 99.81% |
| 8 | 1/1769 bp | 99.94% |
| 9 | 1/854 bp | 99.88% |
| 10 | 1/1451 bp | 99.93% |

Thus, the high quality and uniformity of the synthesized polynucleotides were repeated on two chips with different surface chemistries. Overall, 89% of the 100-mers that were sequenced were perfect sequences with no errors, corresponding to 233 out of 262.

Table 3 summarizes error characteristics for the sequences obtained from the polynucleotide samples from spots 1-10.

TABLE 3

Error characteristics

| | Sample ID/Spot no. | | | | |
|---|---|---|---|---|---|
| | OSA_0046/1 | OSA_0047/2 | OSA_0048/3 | OSA_0049/4 | OSA_0050/5 |
| Total Sequences | 32 | 32 | 32 | 32 | 32 |
| Sequencing Quality | 25 of 28 | 27 of 27 | 26 of 30 | 21 of 23 | 25 of 26 |
| Oligo Quality | 23 of 25 | 25 of 27 | 22 of 26 | 18 of 21 | 24 of 25 |
| ROI Match Count | 2500 | 2698 | 2561 | 2122 | 2499 |
| ROI Mutation | 2 | 2 | 1 | 3 | 1 |
| ROI Multi Base Deletion | 0 | 0 | 0 | 0 | 0 |
| ROI Small Insertion | 1 | 0 | 0 | 0 | 0 |
| ROI Single Base Deletion | 0 | 0 | 0 | 0 | 0 |
| Large Deletion Count | 0 | 0 | 1 | 0 | 0 |
| Mutation: G > A | 2 | 2 | 1 | 2 | 1 |
| Mutation: T > C | 0 | 0 | 0 | 1 | 0 |
| ROI Error Count | 3 | 2 | 2 | 3 | 1 |
| ROI Error Rate | Err: ~1 in 834 | Err: ~1 in 1350 | Err: ~1 in 1282 | Err: ~1 in 708 | Err: ~1 in 2500 |
| ROI Minus Primer Error Rate | MP Err: ~1 in 763 | MP Err: ~1 in 824 | MP Err: ~1 in 780 | MP Err: ~1 in 429 | MP Err: ~1 in 1525 |

| | Sample ID/Spot no. | | | | |
|---|---|---|---|---|---|
| | OSA_0051/6 | OSA_0052/7 | OSA_0053/8 | OSA_0054/9 | OSA_0055/10 |
| Total Sequences | 32 | 32 | 32 | 32 | 32 |
| Sequencing Quality | 29 of 30 | 27 of 31 | 29 of 31 | 28 of 29 | 25 of 28 |
| Oligo Quality | 25 of 29 | 22 of 27 | 28 of 29 | 26 of 28 | 20 of 25 |
| ROI Match Count | 2666 | 2625 | 2899 | 2798 | 2348 |
| ROI Mutation | 0 | 2 | 1 | 2 | 1 |
| ROI Multi Base Deletion | 0 | 0 | 0 | 0 | 0 |
| ROI Small Insertion | 0 | 0 | 0 | 0 | 0 |
| ROI Single Base Deletion | 0 | 0 | 0 | 0 | 0 |
| Large Deletion Count | 1 | 1 | 0 | 0 | 0 |
| Mutation: G > A | 0 | 2 | 1 | 2 | 1 |
| Mutation: T > C | 0 | 0 | 0 | 0 | 0 |
| ROI Error Count | 1 | 3 | 1 | 2 | 1 |
| ROI Error Rate | Err: ~1 in 2667 | Err: ~1 in 876 | Err: ~1 in 2900 | Err: ~1 in 1400 | Err: ~1 in 2349 |
| ROI Minus Primer Error Rate | MP Err: ~1 in 1615 | MP Err: ~1 in 531 | MP Err: ~1 in 1769 | MP Err: ~1 in 854 | MP Err: ~1 in 1451 |

Example 4: Exemplary Sequences

TABLE 4

| | | Variable Heavy Chain CDRs | | | | |
|---|---|---|---|---|---|---|
| DKK1 Variant | SEQ ID NO | CDR1 Sequence | SEQ ID NO | CDR2 Sequence | SEQ ID NO | CDR3 Sequence |
| DKK1-1 | 1 | GRTFSRFAM | 99 | EGVASITSGGTTNY | 197 | AADDGARGSW |
| DKK1-2 | 2 | GSAFSSTVM | 100 | EFVATINSLGGTSY | 198 | AAAYSGHFSGRVSDFLW |
| DKK1-3 | 3 | GSTFSTYAM | 101 | EFVASINWGGGNTYY | 199 | AAKKVSFGDW |
| DKK1-4 | 4 | GNIFRINAM | 102 | ELVAAISRSGGSTNY | 200 | AKDKNGPW |
| DKK1-5 | 5 | GGLTFSTYAM | 103 | EFVAAVSWSGGNTYY | 201 | AAEIGYYSGGTYYSSEAW |
| DKK1-6 | 6 | GIPFSTRTM | 104 | EFVAAISSGATTLY | 202 | AAGNGGRAYGYSRARYEW |
| DKK1-7 | 7 | GISGSVFSRTPM | 105 | EFVAALSKDGARTYY | 203 | ARDLVGTDAFDIW |
| DKK1-8 | 8 | GFTFSNYAM | 106 | EFVAAISWSDGSTYY | 204 | AAEGGYSGTYYYTGDFDW |
| DKK1-9 | 9 | GRSFSMYAM | 107 | ELVAAISWSGGSTVY | 205 | AAEGGYSGTYYYTGDFDW |
| DKK1-10 | 10 | GRTISNYAM | 108 | EFVAAISWRGGSTYY | 206 | AAAPRPKYVSVSYFSTSSNYDW |
| DKK1-11 | 11 | GPTVDAYAM | 109 | EFVSAISWSGSATFY | 207 | AAAPRPKRVSVRYFSTSSNYDW |
| DKK1-12 | 12 | GRTFNSRPM | 110 | EFVAAISSSASSTYY | 208 | AAGNGGRLYGHSRARYDW |
| DKK1-13 | 13 | GFLMYDRAM | 111 | EIVAAISRTGSSIYY | 209 | AAGNGGRKYGHHRARYDW |
| DKK1-14 | 14 | GSIFSRLAM | 112 | EFVAAISSSGISTIY | 210 | ARGQRGRWLEPLTGW |
| DKK1-15 | 15 | GFTFGTTTM | 113 | ELVAAITSGGGTTYY | 211 | AKDLAAAGYYYYYGMDVW |
| DKK1-16 | 16 | GNIFTRNVM | 114 | EFVGAINWSGGNTVY | 212 | ARHDHNNRGLDYW |
| DKK1-17 | 17 | GGTFSRYAM | 115 | EFVAGISWTLGRTYY | 213 | ARDPFGKW |
| DKK1-18 | 18 | GITFRFKAM | 116 | EFVAAINRSGRSTRY | 214 | AAESHGSTSPRNPLQYDW |
| DKK1-19 | 19 | GRTYGM | 117 | EFVAGISWTLGRTYY | 215 | ASDESDAANW |
| DKK1-20 | 20 | GPTFSIYDM | 118 | EFVTGSNTGGTTY | 216 | ATCTDFEYDW |
| DKK1-21 | 21 | GIPSSIRAM | 119 | EWVSGISISDSSTYY | 217 | AAGKRYGYYDW |
| DKK1-22 | 22 | GSTLSINAM | 120 | ELVAAISWSGGTAY | 218 | AAQSRYRSNYYDHDKYAW |
| DKK1-23 | 23 | GYNFSTFCM | 121 | EWVAAISGGGSTMY | 219 | AASKWYGGFGDTDIEW |
| DKK1-24 | 24 | GSSFSAYGM | 122 | EFVAGISWTLGRTYY | 220 | AADGVPEYSDYASGPVW |
| DKK1-25 | 25 | GSTSRSYGM | 123 | EFVAGISWTLGRTYY | 221 | ARDPSGKW |
| DKK1-26 | 26 | GFSLDYYGM | 124 | EVVASIRWNAKPYY | 222 | AAGKRYGYYDW |
| DKK1-27 | 27 | GRTFSNYAM | 125 | EWVASISTSGKTTYY | 223 | AAGNGGRNYGHSRARYEW |
| DKK1-28 | 28 | GLTTVYTM | 126 | EFVAAISWYVSTTFY | 224 | AAEGGYSGTYYYTGDFDW |
| DKK1-29 | 29 | GSIGGLNAM | 127 | EFVAAINYSGRSTVY | 225 | AAGAGRDRGFSRAQYAW |
| DKK1-30 | 30 | GRTFSKYAM | 128 | EFVAAISWSGESTYY | 226 | AAAPRPKRVSVSYFYTSSNYDW |
| DKK1-31 | 31 | GRTLSRSAM | 129 | ELVAAISWSGGSTYY | 227 | AAGNGGRTYGHSRARYEW |
| DKK1-32 | 32 | GRTFSNGPM | 130 | EFVAAISRGGKISHY | 228 | AAGNGGRYYGHSRARYDW |
| DKK1-33 | 33 | GRSLNTYTM | 131 | ELVAVIISGGSTAY | 229 | AAGNGGRSYGHSRARYDW |
| DKK1-34 | 34 | GFTFDDRAM | 132 | EFVAAISWSGGSTYY | 230 | AAAPRPKRVSVSYFYTSSNYDW |
| DKK1-35 | 35 | GRTFTTYPM | 133 | EFVAAISSSGSSTVY | 231 | AAGNGGRQYGHSRARYDW |
| DKK1-36 | 36 | GIPSTLRAM | 134 | EFVAAINWSGASTVY | 232 | AAGNGGRQYGHSRARYDW |
| DKK1-37 | 37 | GRTFSSYSM | 135 | EFIAAINLSSGSTYY | 233 | AAGNGGRNYGHSRARYEW |

TABLE 4-continued

Variable Heavy Chain CDRs

| DKK1 Variant | SEQ ID NO | CDR1 Sequence | SEQ ID NO | CDR2 Sequence | SEQ ID NO | CDR3 Sequence |
| --- | --- | --- | --- | --- | --- | --- |
| DKK1-38 | 38 | GTSFSIGAM | 136 | EWVSSISPGGLFPYY | 234 | AARDAIVGVTDTSGYRW |
| DKK1-39 | 39 | GTVFSISDM | 137 | EWVSAISPGGGYTVY | 235 | ARSSWFDCGVQGRDLGNEYDW |
| DKK1-40 | 40 | GRTISSFRM | 138 | EFVAAISRGGNVTPY | 236 | AANSDSGFDSYSVWAAYEW |
| DKK1-41 | 41 | GRTLSRS | 139 | SWSGGS | 237 | GNGGRTYGHSRARYE |
| DKK1-42 | 42 | GRTFSSL | 140 | TSGGR | 238 | GNGGRTYGHSRARYE |
| DKK1-43 | 43 | GTSFSVG | 141 | SWSGGT | 239 | GNGGRQYGHSRARYD |
| DKK1-44 | | GRG | 142 | NRSGKS | 240 | GNGGRSYGHSRARYD |
| DKK1-45 | 45 | GRTFSNF | 143 | SATGS | 241 | GNGGRQYGHSRARYD |
| DKK1-46 | 46 | GRTLSSI | 144 | TRAGS | 242 | GNGGRYYGHSRARYD |
| DKK1-47 | 47 | GRTFSSL | 145 | SSGGS | 243 | GNGGRTYGHSRARYD |
| DKK1-48 | 48 | GRSFGNF | 146 | TSGGS | 244 | GNGGRSYGHSRARYD |
| DKK1-49 | 49 | GFTFTNY | 147 | NWSGRR | 245 | APRPKRVSVQYFSTSSNYD |
| DKK1-50 | 50 | GRTFSLY | 148 | NRSGKS | 246 | GNGGRQYGHSRARYD |
| DKK1-51 | 51 | GRTFSTS | 149 | NRSGKT | 247 | GNGGRAYGYSRARYE |
| DKK1-52 | 52 | GRTFSIS | 150 | SPSGN | 248 | GNGGRAYGYSRARYE |
| DKK1-53 | 53 | GRTFSSY | 151 | SRSGT | 249 | GNGGRTYGHSRARYE |
| DKK1-54 | 54 | GFTFDDR | 152 | STGGT | 250 | GNGGRTYGHSRARYE |
| DKK1-55 | 55 | GFTFGDY | 153 | DWSGRR | 251 | APRPKRVSVSYFSTASNYD |
| DKK1-56 | 56 | GRTFSSL | 154 | SSSGGT | 252 | GNGGRLYGHSRARYD |
| DKK1-57 | 57 | GSTFSKA | 155 | TFSGAR | 253 | GNGGRTYGHSRARYD |
| DKK1-58 | 58 | GRRFSAD | 156 | RSGGT | 254 | GNGGRQYGHSRARYD |
| DKK1-59 | 59 | GFTVSNY | 157 | SWSGGS | 255 | APRPKRVSVRYFSTSSNYD |
| DKK1-60 | 60 | GRAFSSS | 158 | NRGGKI | 256 | GNGGRLYGHSRARYD |
| DKK1-61 | 61 | GRTFSSN | 159 | SRSGGS | 257 | GNGGRTYGHSRARYD |
| DKK1-62 | 62 | GRTFSYN | 160 | NRSGKS | 258 | GNGGRHYGHSRARYD |
| DKK1-63 | 63 | GFRMYDR | 161 | SRSGGR | 259 | GNGGRLYGHSRARYD |
| DKK1-64 | 64 | GRTSSAY | 162 | SRSGAS | 260 | GNGGRSYGHSRARYD |
| DKK1-65 | 65 | GRTFSRF | 163 | SARGM | 261 | GNGGRTYGHSRARYE |
| DKK1-66 | 66 | GRTFSSY | 164 | NLSSGS | 262 | GNGGRNYGHSRARYE |
| DKK1-67 | 67 | GRTFRSY | 165 | SMSGKE | 263 | GNGGRTYGHSRARYE |
| DKK1-68 | 68 | GRTFSNY | 166 | STSGKT | 264 | GNGGRNYGHSRARYE |
| DKK1-69 | 69 | GRTFSSY | 167 | SRSGGS | 265 | GNGGRHYGHSRARYD |
| DKK1-70 | 70 | GTSFSIG | 168 | SRSGAS | 266 | GNGGRTYGHSRARYD |
| DKK1-71 | 71 | GRTISNA | 169 | RSGGT | 267 | GNGGRQYGHSRARYD |
| DKK1-72 | 72 | GGIYRVN | 170 | NWSGGS | 268 | GNGGRKYGHHRARYD |
| DKK1-73 | 73 | GRTFSSK | 171 | NWSGGL | 269 | GNGGRAYGYSRARYE |
| DKK1-74 | 74 | GIPFSSR | 172 | SRSGTG | 270 | GNGGRTYGHSRARYD |

TABLE 4-continued

Variable Heavy Chain CDRs

| DKK1 Variant | SEQ ID NO | CDR1 Sequence | SEQ ID NO | CDR2 Sequence | SEQ ID NO | CDR3 Sequence |
|---|---|---|---|---|---|---|
| DKK1-75 | 75 | GPTVDAY | 173 | SWSGSA | 271 | APRPKRVSVRYFSTSSNYD |
| DKK1-76 | 76 | GIPFSTR | 174 | SSGAT | 272 | GNGGRAYGYSRARYE |
| DKK1-77 | 77 | GRTFNSR | 175 | SSSASS | 273 | GNGGRLYGHSRARYD |
| DKK1-78 | 78 | GFTFSSS | 176 | LRGGS | 274 | GNGGRHYGHSRARYD |
| DKK1-79 | 79 | SIGIAFSSR | 177 | TRSGGK | 275 | GNGGRTYGHSRARYE |
| DKK1-80 | 80 | GFLMYDR | 178 | SRTGSS | 276 | GNGGRKYGHHRARYD |
| DKK1-81 | 81 | GIAFQGY | 179 | DTNGGH | 277 | EGGYRGTYYYTGDFD |
| DKK1-82 | 82 | GRTFSNT | 180 | TSGGS | 278 | GNGGRHYGHNRPRYD |
| DKK1-83 | 83 | GSTSSLR | 181 | SWSLSR | 279 | APRPKRVSVSYFSTASNYD |
| DKK1-84 | 84 | GRTFTNY | 182 | NRGGST | 280 | GNRRPYGYSHSRYD |
| DKK1-85 | 85 | GITFKRY | 183 | TSRDGTT | 281 | GNGGRNYGHSRSRYE |
| DKK1-86 | 86 | GRTFINY | 184 | IWTGVS | 282 | APRPNRVSVRYFSTNNNYD |
| DKK1-87 | 87 | GRTFSGY | 185 | SWSGGS | 283 | GNGGRHYGHSRARYD |
| DKK1-88 | 88 | GLTFSTY | 186 | ASNGN | 284 | GNGGRAYGYSRARYE |
| DKK1-89 | 89 | GFTSDDY | 187 | SWSGGR | 285 | APRPKRVSVRYFSTSSNYD |
| DKK1-90 | 90 | GRTFRSY | 188 | SWSPGR | 286 | APRPKRISVQYFTTSSNYD |
| DKK1-91 | 91 | GFTVSSY | 189 | SWSGGR | 287 | APRPKRVSFSYFSTSSNYE |
| DKK1-92 | 92 | GFGFGSY | 190 | SWTGGS | 288 | APRPKRVSVRYFNTSSNYD |
| DKK1-93 | 93 | GRTFSRY | 191 | SWSGGS | 289 | GNGGRYYNHSRTRYE |
| DKK1-94 | 94 | GRIFGGY | 192 | SWSGAS | 290 | GNGGSRYGHSRARYD |
| DKK1-95 | 95 | GSIENIN | 193 | SSGGGI | 291 | GNGGRKYGHHRARYD |
| DKK1-96 | 96 | GFTFSSFGNF | 194 | NWSSRS | 292 | GNGGRQYGHSRARYD |
| DKK1-97 | 97 | GNIDRLY | 195 | SWSVSS | 293 | EGGYSGTYYYTGDFD |
| DKK1-98 | 98 | GRTFSNF | 196 | LRGGS | 294 | APRPKRVSVSYFSTASNYD |
| DKK1-99 | 919 | GRTFSNF | 1333 | LRGGS | 1747 | APRPKRVSVSYFSTASNYD |
| DKK1-100 | 920 | GNIDRLY | 1334 | SWSVSS | 1748 | EGGYSGTYYYTGDFD |
| DKK1-101 | 921 | GFTFSSFGNF | 1335 | NWSSRS | 1749 | GNGGRQYGHSRARYD |
| DKK1-102 | 922 | GSIENIN | 1336 | SSGGGI | 1750 | GNGGRKYGHHRARYD |
| DKK1-103 | 923 | GRIFGGY | 1337 | SWSGAS | 1751 | GNGGSRYGHSRARYD |
| DKK1-104 | 924 | GRTFSRY | 1338 | SWSGGS | 1752 | GNGGRYYNHSRTRYE |
| DKK1-105 | 925 | GFGFGSY | 1339 | SWTGGS | 1753 | APRPKRVSVRYFNTSSNYD |
| DKK1-106 | 926 | GFTVSSY | 1340 | SWSGGR | 1754 | APRPKRVSFSYFSTSSNYE |
| DKK1-107 | 927 | GRTFRSY | 1341 | SWSPGR | 1755 | APRPKRISVQYFTTSSNYD |
| DKK1-108 | 928 | GFTSDDY | 1342 | SWSGGR | 1756 | APRPKRVSVRYFSTSSNYD |
| DKK1-109 | 929 | GLTFSTY | 1343 | ASNGN | 1757 | GNGGRAYGYSRARYE |
| DKK1-110 | 930 | GRTFSGY | 1344 | SWSGGS | 1758 | GNGGRHYGHSRARYD |
| DKK1-111 | 931 | GRTFINY | 1345 | IWTGVS | 1759 | APRPNRVSVRYFSTNNNYD |
| DKK1-112 | 932 | GITFKRY | 1346 | TSRDGTT | 1760 | GNGGRNYGHSRSRYE |

TABLE 4-continued

Variable Heavy Chain CDRs

| DKK1 Variant | SEQ ID NO | CDR1 Sequence | SEQ ID NO | CDR2 Sequence | SEQ ID NO | CDR3 Sequence |
|---|---|---|---|---|---|---|
| DKK1-113 | 933 | GRTFTNY | 1347 | NRGGST | 1761 | GNRRRPYGYSHSRYD |
| DKK1-114 | 934 | GSTSSLR | 1348 | SWSLSR | 1762 | APRPKRVSVSYFSTASNYD |
| DKK1-115 | 935 | GRTFSNT | 1349 | TSGGS | 1763 | GNGGRHYGHNRPRYD |
| DKK1-116 | 936 | GIAFQGY | 1350 | DTNGGH | 1764 | EGGYRGTYYYTGDFD |
| DKK1-117 | 937 | GFLMYDR | 1351 | SRTGSS | 1765 | GNGGRKYGHHRARYD |
| DKK1-118 | 938 | SIGIAFSSR | 1352 | TRSGGK | 1766 | GNGGRTYGHSRARYE |
| DKK1-119 | 939 | GFTFSSS | 1353 | LRGGS | 1767 | GNGGRHYGHSRARYD |
| DKK1-120 | 940 | GRTFNSR | 1354 | SSSASS | 1768 | GNGGRLYGHSRARYD |
| DKK1-121 | 941 | GIPFSTR | 1355 | SSGAT | 1769 | GNGGRAYGYSRARYE |
| DKK1-122 | 942 | GPTVDAY | 1356 | SWSGSA | 1770 | APRPKRVSVRYFSTSSNYD |
| DKK1-123 | 943 | GIPFSSR | 1357 | SRSGTG | 1771 | GNGGRTYGHSRARYD |
| DKK1-124 | 944 | GRTFSSK | 1358 | NWSGGL | 1772 | GNGGRAYGYSRARYE |
| DKK1-125 | 945 | GGIYRVN | 1359 | NWSGGS | 1773 | GNGGRKYGHHRARYD |
| DKK1-126 | 946 | GRTISNA | 1360 | RSGGT | 1774 | GNGGRQYGHSRARYD |
| DKK1-127 | 947 | GTSFSIG | 1361 | SRSGAS | 1775 | GNGGRTYGHSRARYD |
| DKK1-128 | 948 | GRTFSSY | 1362 | SRSGGS | 1776 | GNGGRHYGHSRARYD |
| DKK1-129 | 949 | GRTFSNY | 1363 | STSGKT | 1777 | GNGGRNYGHSRARYE |
| DKK1-130 | 950 | GRTFRSY | 1364 | SMSGKE | 1778 | GNGGRTYGHSRARYE |
| DKK1-131 | 951 | GRTFSSY | 1365 | NLSSGS | 1779 | GNGGRNYGHSRARYE |
| DKK1-132 | 952 | GRTFSRF | 1366 | SARGM | 1780 | GNGGRTYGHSRARYE |
| DKK1-133 | 953 | GRTSSAY | 1367 | SRSGAS | 1781 | GNGGRSYGHSRARYD |
| DKK1-134 | 954 | GFRMYDR | 1368 | SRSGGR | 1782 | GNGGRLYGHSRARYD |
| DKK1-135 | 955 | GRTFSYN | 1369 | NRSGKS | 1783 | GNGGRHYGHSRARYD |
| DKK1-136 | 956 | GRTFSSN | 1370 | SRSGGS | 1784 | GNGGRTYGHSRARYD |
| DKK1-137 | 957 | GRAFSSS | 1371 | NRGGKI | 1785 | GNGGRLYGHSRARYD |
| DKK1-138 | 958 | GFTVSNY | 1372 | SWSGGS | 1786 | APRPKRVSVRYFSTSSNYD |
| DKK1-139 | 959 | GRRFSAD | 1373 | RSGGT | 1787 | GNGGRQYGHSRARYD |
| DKK1-140 | 960 | GSTFSKA | 1374 | TFSGAR | 1788 | GNGGRTYGHSRARYD |
| DKK1-141 | 961 | GRTFSSL | 1375 | SSSGGT | 1789 | GNGGRLYGHSRARYD |
| DKK1-142 | 962 | GFTFGDY | 1376 | DWSGRR | 1790 | APRPKRVSVSYFSTASNYD |
| DKK1-143 | 963 | GFTFDDR | 1377 | STGGT | 1791 | GNGGRTYGHSRARYE |
| DKK1-144 | 964 | GRTFSSY | 1378 | SRSGT | 1792 | GNGGRTYGHSRARYE |
| DKK1-145 | 965 | GRTFSIS | 1379 | SPSGN | 1793 | GNGGRAYGYSRARYE |
| DKK1-146 | 966 | GRTFSTS | 1380 | NRSGKT | 1794 | GNGGRAYGYSRARYE |
| DKK1-147 | 967 | GRTFSLY | 1381 | NRSGKS | 1795 | GNGGRQYGHSRARYD |
| DKK1-148 | 968 | GFTFTNY | 1382 | NWSGRR | 1796 | APRPKRVSVQYFSTSSNYD |
| DKK1-149 | 969 | GRSFGNF | 1383 | TSGGS | 1797 | GNGGRSYGHSRARYD |

TABLE 4-continued

Variable Heavy Chain CDRs

| DKK1 Variant | SEQ ID NO | CDR1 Sequence | SEQ ID NO | CDR2 Sequence | SEQ ID NO | CDR3 Sequence |
| --- | --- | --- | --- | --- | --- | --- |
| DKK1-150 | 970 | GRTFSSL | 1384 | SSGGS | 1798 | GNGGRTYGHSRARYD |
| DKK1-151 | 971 | GRTLSSI | 1385 | TRAGS | 1799 | GNGGRYYGHSRARYD |
| DKK1-152 | 972 | GRTFSNF | 1386 | SATGS | 1800 | GNGGRQYGHSRARYD |
| DKK1-153 | | GRG | 1387 | NRSGKS | 1801 | GNGGRSYGHSRARYD |
| DKK1-154 | 974 | GTSFSVG | 1388 | SWSGGT | 1802 | GNGGRQYGHSRARYD |
| DKK1-155 | 975 | GRTFSSL | 1389 | TSGGR | 1803 | GNGGRTYGHSRARYE |
| DKK1-156 | 976 | GRTLSRS | 1390 | SWSGGS | 1804 | GNGGRTYGHSRARYE |
| DKK1-157 | 977 | GRTISNY | 1391 | SWRGGS | 1805 | APRPKYVSVSYFSTSSNYD |
| DKK1-158 | 978 | GHTFRGY | 1392 | SGRSGN | 1806 | GNGGRLYGHSRARYD |
| DKK1-159 | 979 | GSIVRGN | 1393 | SSSGSS | 1807 | GNGGRTYGHSRARYE |
| DKK1-160 | 980 | GRTFSSY | 1394 | SRSGGS | 1808 | GNGGRTYGHSRARYE |
| DKK1-161 | 981 | GNIFGVN | 1395 | SGTGGS | 1809 | GNGGRTYGHSRARYE |
| DKK1-162 | 982 | GHTFRGY | 1396 | NRSGSS | 1810 | GNGGRAYGYSRARYE |
| DKK1-163 | 983 | GRTLRRY | 1397 | ISDGN | 1811 | GNGGRQYGHSRARYD |
| DKK1-164 | 984 | GRALSSS | 1398 | WSGGR | 1812 | GNGGRYYGHSRARYD |
| DKK1-165 | 985 | GRTFSNG | 1399 | TSTGS | 1813 | GNGGRLYGHSRARYD |
| DKK1-166 | 986 | GLTFGSA | 1400 | TSGGR | 1814 | GNGGRQYGHSRARYD |
| DKK1-167 | 987 | GFTFGST | 1401 | NWSGRR | 1815 | APRPKRVSVSYFYTSSNYD |
| DKK1-168 | 988 | GRFTSSS | 1402 | TSGGR | 1816 | GNGGRAYGYSRARYE |
| DKK1-169 | 989 | GRTFNSR | 1403 | TSDGS | 1817 | GNGGRQYGHSRARYD |
| DKK1-170 | 990 | GRTLSS | 1404 | SQRG | 1818 | GNGGRQYGHSRARYD |
| DKK1-171 | 991 | GGTFSRY | 1405 | NRSGKS | 1819 | GNGGRQYGHSRARYD |
| DKK1-172 | 992 | GRTFNSR | 1406 | SSGST | 1820 | GNGGRSYGHSRARYD |
| DKK1-173 | 993 | GSTFRGA | 1407 | TSAGGT | 1821 | GNGGRQYGHSRARYD |
| DKK1-174 | 994 | GSTFSKA | 1408 | LSSGA | 1822 | GNGGRHYGHSRARYD |
| DKK1-175 | 995 | GTTFRIN | 1409 | SRSGGS | 1823 | GNGGRSYGHSRARYD |
| DKK1-176 | 996 | GFPVNRY | 1410 | SRSGGS | 1824 | GNGGRQYGHSRARYD |
| DKK1-177 | 997 | GHTFNTY | 1411 | TSNGR | 1825 | GNGGRAYGYSRARYE |
| DKK1-178 | 998 | GRTFGRR | 1412 | NWSGGS | 1826 | GNGGRHYGHSRARYD |
| DKK1-179 | 999 | GFTFSSY | 1413 | SRSGGT | 1827 | GNGGRNYGHSRARYD |
| DKK1-180 | 1000 | GRTFSNF | 1414 | SSGGR | 1828 | GNGGRHYGHSRARYD |
| DKK1-181 | 1001 | GLTTVY | 1415 | SRTGGS | 1829 | GNGGRTYGHSRARYE |
| DKK1-182 | 1002 | GTTFRIN | 1416 | NRSGKS | 1830 | GNGGRQYGHSRARYD |
| DKK1-183 | 1003 | GRTFSTH | 1417 | TRLGV | 1831 | GNGGRAYGYSRARYE |
| DKK1-184 | 1004 | GIPSTLR | 1418 | NWSGAS | 1832 | GNGGRQYGHSRARYD |
| DKK1-185 | 1005 | GRTFSSY | 1419 | DWSGSR | 1833 | APRPKRVSVSYFYTSSNYD |
| DKK1-186 | 1006 | GRTFSDI | 1420 | NWSGAR | 1834 | APRPKRVSVQYFSTSSNYD |
| DKK1-187 | 1007 | GIPFSTR | 1421 | SWSGGS | 1835 | GNGGRQYGHSRARYD |

TABLE 4-continued

Variable Heavy Chain CDRs

| DKK1 Variant | SEQ ID NO | CDR1 Sequence | SEQ ID NO | CDR2 Sequence | SEQ ID NO | CDR3 Sequence |
|---|---|---|---|---|---|---|
| DKK1-188 | 1008 | GFTFDEY | 1422 | DWSGRR | 1836 | APRPKRISVSYFSTSSNYD |
| DKK1-189 | 1009 | GFTFSNY | 1423 | SWSGGS | 1837 | APRPKRVSFSYFSTSSNYE |
| DKK1-190 | 1010 | GITFKRY | 1424 | NWSGAS | 1838 | GNGGRQYGHSRARYD |
| DKK1-191 | 1011 | GFTFGHY | 1425 | SWSLTR | 1839 | APRPKRVSVQYFSTSSNYD |
| DKK1-192 | 1012 | GSITSIN | 1426 | SRSGAS | 1840 | GNGGRTYGHSRARYE |
| DKK1-193 | 1013 | GGRIFSNY | 1427 | SWSGGS | 1841 | APRPKRVSVSYFSTASNYD |
| DKK1-194 | 1014 | GRTF | 1428 | NWRSGGS | 1842 | GNGGRTYGHSRARYE |
| DKK1-195 | 1015 | GGTFNGR | 1429 | SRSGGG | 1843 | GNGGRQYGHSRARYD |
| DKK1-196 | 1016 | GFNFDDY | 1430 | SWSLSR | 1844 | APRPKRVSVSYFSTASNYD |
| DKK1-197 | 1017 | SIGIAFSSR | 1431 | TRSGGK | 1845 | GNGGRSYGHSRARYD |
| DKK1-198 | 1018 | GSTFRIN | 1432 | SASGS | 1846 | GNGGRTYGHSRARYE |
| DKK1-199 | 1019 | GGIYRVN | 1433 | NWSGGS | 1847 | GNGGRQYGHSRARYD |
| DKK1-200 | 1020 | GRSLNTY | 1434 | ISGGS | 1848 | GNGGRSYGHSRARYD |
| DKK1-201 | 1021 | GRTFSNY | 1435 | STSGKT | 1849 | GNGGRQYGHSRARYD |
| DKK1-202 | 1022 | GTTVRIR | 1436 | NGGGN | 1850 | GNGGRQYGHSRARYD |
| DKK1-203 | 1023 | GRTFSTY | 1437 | NWSGSS | 1851 | GNGGRHYGHSRARYD |
| DKK1-204 | 1024 | GIPFSTR | 1438 | SSGAT | 1852 | GNGGRHYGHSRARYD |
| DKK1-205 | 1025 | GRTFSRY | 1439 | RIKDGS | 1853 | GNGGRQYGHSRARYD |
| DKK1-206 | 1026 | GHTFNTY | 1440 | SRSGGK | 1854 | GNGGRNYGHSRARYE |
| DKK1-207 | 1027 | GRSFSEY | 1441 | SRDGAA | 1855 | GNGGRKYGHHRARYD |
| DKK1-208 | 1028 | GRTFTTY | 1442 | SSSGSS | 1856 | GNGGRQYGHSRARYD |
| DKK1-209 | 1029 | GRTFSRY | 1443 | SWSGGS | 1857 | GNGGRQYGHSRARYD |
| DKK1-210 | 1030 | GSIFTIN | 1444 | NWSGSS | 1858 | GNGGRKYGHHRARYD |
| DKK1-211 | 1031 | GTSISNR | 1445 | SSGGNL | 1859 | GNGGRQYGHSRARYD |
| DKK1-212 | 1032 | GFTFRRYV | 1446 | IEGAGSDT | 1860 | AKQIPGRKWTANGRKDY |
| DKK1-213 | 1033 | GFTFNKYP | 1447 | ISPSGKKK | 1861 | AKYPKNFDY |
| DKK1-214 | 1034 | GFTFSSAA | 1448 | ISGGGADT | 1862 | ARLPKRGPRFDY |
| DKK1-215 | 1035 | GFTFNKYP | 1449 | IQQRGLKT | 1863 | AKGIRGWIGHDTQPFDY |
| DKK1-216 | 1036 | GFTFDRYR | 1450 | ISPSGKKK | 1864 | AKYPKNFDY |
| DKK1-217 | 1037 | GFTSNNFA | 1451 | ISGGGADT | 1865 | AKLQKRGPRFDY |
| DKK1-218 | 1038 | GFTFGNYA | 1452 | ISSSGGET | 1866 | VKAPLRSGGVDY |
| DKK1-219 | 1039 | GFTFDRYR | 1453 | ISPSGKKK | 1867 | AKFPSTHGKFDY |
| DKK1-220 | 1040 | GLTFPNYG | 1454 | IDDRGRYT | 1868 | ARVIAAAGAFDY |
| DKK1-221 | 1041 | GFTFNKYP | 1455 | ISNSGST | 1869 | AKRTSKFDY |
| DKK1-222 | 1042 | GFTFTHYS | 1456 | ITRSGST | 1870 | AKRTENRGVSFDY |
| DKK1-223 | 1043 | GFTFEEKE | 1457 | ISSSGLWT | 1871 | AKGWRRFDY |
| DKK1-224 | 1044 | GFTFDRYR | 1458 | ISPSGKKK | 1872 | AKYTWNGY |

TABLE 4-continued

Variable Heavy Chain CDRs

| DKK1 Variant | SEQ ID NO | CDR1 Sequence | SEQ ID NO | CDR2 Sequence | SEQ ID NO | CDR3 Sequence |
|---|---|---|---|---|---|---|
| DKK1-225 | 1045 | GFTFHKYG | 1459 | ISPSGKKK | 1873 | ASLSRGY |
| DKK1-226 | 1046 | GFTFGNYA | 1460 | IWPRGQKT | 1874 | AKFRGRGFDY |
| DKK1-227 | 1047 | GFTFAKYK | 1461 | ISPSGKKK | 1875 | AKAHNAFDY |
| DKK1-228 | 1048 | GFTFSSYF | 1462 | ISGGGADT | 1876 | ARGNYFDY |
| DKK1-229 | 1049 | GFTFDRYR | 1463 | ISGYGSTT | 1877 | AKFRGRGFDY |
| DKK1-230 | 1050 | GFTFSRYA | 1464 | IGANGAPT | 1878 | AKDKRYRGSQHYFDY |
| DKK1-231 | 1051 | GFTFRSYT | 1465 | ISNSGGST | 1879 | AKAGRKFDY |
| DKK1-232 | 1052 | GFTFSDYD | 1466 | IGASGSAT | 1880 | AKQSGSEDHFDY |
| DKK1-233 | 1053 | GFTFRRYV | 1467 | ISPSGKKK | 1881 | AKWRREGYTGSKFDY |
| DKK1-234 | 1054 | GGFSLSRY | 1468 | INQAGLRT | 1882 | AKSRTGRYFDY |
| DKK1-235 | 1055 | GFTFHKYG | 1469 | INPSRGYT | 1883 | AKGYRHFDY |
| DKK1-236 | 1056 | GFTFNKYP | 1470 | ISSSGGET | 1884 | AKDLGQGFDY |
| DKK1-237 | 1057 | GFTFNKYP | 1471 | ISSSGSST | 1885 | AKRTRSKFDY |
| DKK1-238 | 1058 | GFTFRRYV | 1472 | ISGGGADT | 1886 | AGLPKRGPRFDY |
| DKK1-239 | 1059 | GFTFSRYA | 1473 | IGPSGGKT | 1887 | ARLPKRGPWFDY |
| DKK1-240 | 1060 | GFTFRRYV | 1474 | ISGGGADT | 1888 | AKPSRRFDY |
| DKK1-241 | 1061 | GFTFSSYV | 1475 | IQQRGLKT | 1889 | ARSGPYYFDY |
| DKK1-242 | 1062 | GFTFEDYQ | 1476 | ITGTGGET | 1890 | AKPGHRFDY |
| DKK1-243 | 1063 | GFTFRRYV | 1477 | IYPSGGST | 1891 | AKDRYSQVHYALDY |
| DKK1-244 | 1064 | GFTFKAYE | 1478 | ISPSGGIT | 1892 | ARHRAGSSGWYSDY |
| DKK1-245 | 1065 | GFTFEVYT | 1479 | ISGRGDNT | 1893 | AKRTENRGVSFDY |
| DKK1-246 | 1066 | GFTFGNYS | 1480 | IWPRGQKT | 1894 | AKVTGRGFDY |
| DKK1-247 | 1067 | GFTFRRYV | 1481 | VNPNSGTS | 1895 | AKGPGTRGDY |
| DKK1-248 | 1068 | GFTFSNYG | 1482 | ISPSGGWT | 1896 | ARYGAYFGLDY |
| DKK1-249 | 1069 | GFTFAHEP | 1483 | INYAGNT | 1897 | AKKDYDYVWGSPYFDY |
| DKK1-250 | 1070 | GFTFHEST | 1484 | ISSSGGET | 1898 | ARIRVGPSGGAFDY |
| DKK1-251 | 1071 | GFTFNKYP | 1485 | ISPSGKKK | 1899 | AKFPSSQFRFDY |
| DKK1-252 | 1072 | GFTFNKYP | 1486 | ISPSGKKK | 1900 | AKYPKNFNY |
| DKK1-253 | 1073 | GFTFHKYG | 1487 | INYAGNT | 1901 | AKDKRYRGSQHYFDY |
| DKK1-254 | 1074 | GLTFPNYG | 1488 | ISPSGKKK | 1902 | AREGLWAFDY |
| DKK1-255 | 1075 | GFTFKAYE | 1489 | IIPNGGIT | 1903 | GRHRAGSIGWYSDY |
| DKK1-256 | 1076 | GFTFRRYV | 1490 | IGASGSAT | 1904 | AKRTRSKFDY |
| DKK1-257 | 1077 | GFTFRRYV | 1491 | ISGGGADT | 1905 | AKGRRRFDY |
| DKK1-258 | 1078 | GFTSNNFA | 1492 | ISGGGADT | 1906 | AKLQKRGPRFDY |
| DKK1-259 | 1079 | GFTFGNYA | 1493 | IWARGQKT | 1907 | AHLPGRGFEY |
| DKK1-260 | 1080 | GFTFEDET | 1494 | IISSGGLT | 1908 | AKGFRIFDY |
| DKK1-261 | 1081 | GFTFSNSY | 1495 | ITPKGDHT | 1909 | AKGARRFDY |
| DKK1-262 | 1082 | GFTFSGYD | 1496 | IGRHGGRT | 1910 | AKSLGRFDY |

TABLE 4-continued

Variable Heavy Chain CDRs

| DKK1 Variant | SEQ ID NO | CDR1 Sequence | SEQ ID NO | CDR2 Sequence | SEQ ID NO | CDR3 Sequence |
|---|---|---|---|---|---|---|
| DKK1-263 | 1083 | GFTFRRYV | 1497 | IEGAGSDT | 1911 | ARLPKRGPRFDY |
| DKK1-264 | 1084 | GFTFKSYG | 1498 | IWPRGQKT | 1912 | AKSGTRIKQGFDY |
| DKK1-265 | 1085 | GFTFRRYV | 1499 | ISGGGADT | 1913 | ARLPKRGPRFDY |
| DKK1-266 | 1086 | GFTFVAYN | 1500 | ISNSGGST | 1914 | AKNRAKFDY |
| DKK1-267 | 1087 | GFTFRRYV | 1501 | ISSSGGET | 1915 | AKLPKRGPRFDY |
| DKK1-268 | 1088 | GFTFRRYV | 1502 | IEGAGSDT | 1916 | AKFRGRGFDY |
| DKK1-269 | 1089 | GFTFSRYG | 1503 | ISYGGSNK | 1917 | AKGVRKGFDY |
| DKK1-270 | 1090 | GFTFGNYA | 1504 | IQQRGLKT | 1918 | ARGYRGYFDY |
| DKK1-271 | 1091 | GYSISSGYH | 1505 | IDDRGRYT | 1919 | AKSNGRFDY |
| DKK1-272 | 1092 | GFTFRRYV | 1506 | ISGSGGGT | 1920 | AKYFHGKFDY |
| DKK1-273 | 1093 | GFTFHKYG | 1507 | ISPSGKKK | 1921 | AKGRWSIFDY |
| DKK1-274 | 1094 | GFTFRRYV | 1508 | VNPNSGAS | 1922 | AKGPGTRGDY |
| DKK1-275 | 1095 | GFTFNKYP | 1509 | IYPSGGST | 1923 | AKWSSRAFDY |
| DKK1-276 | 1096 | GFTFRRYV | 1510 | IEGAGSDT | 1924 | ARLPKRGPRFDY |
| DKK1-277 | 1097 | GFTFRRYV | 1511 | IEGAGSDT | 1925 | ARLPKRGPRFDY |
| DKK1-278 | 1098 | GFTFSSYV | 1512 | ISPSGKKK | 1926 | AKYPKNFDY |
| DKK1-279 | 1099 | GFTFRRYV | 1513 | ISGGGADT | 1927 | ARLPKRGPRFDY |
| DKK1-280 | 1100 | GFTSNNFA | 1514 | INPSRGYT | 1928 | AKRTENRGVSFDY |
| DKK1-281 | 1101 | GFTFNKYP | 1515 | ISPSGKKK | 1929 | AKFRGRGFDY |
| DKK1-282 | 1102 | GFTFFPYA | 1516 | ISGGGADT | 1930 | ARLPKRGPRFDY |
| DKK1-283 | 1103 | GFTFDQYD | 1517 | ITGSGGST | 1931 | ATAESDDTYDY |
| DKK1-284 | 1104 | GFTFRRYV | 1518 | IEGAGSDT | 1932 | ARLPKRGPRFDY |
| DKK1-285 | 1105 | GFTFRSYT | 1519 | ITGTGGET | 1933 | ARLPKRGPRFDY |
| DKK1-286 | 1106 | GFTFRRYV | 1520 | IEARGGGT | 1934 | AKFRGRGFDY |
| DKK1-287 | 1107 | GFTFGNYA | 1521 | IWPSGGQT | 1935 | AKDKRYRGSQHYFDY |
| DKK1-288 | 1108 | GFTFNKYP | 1522 | SNSGST | 1936 | AKRTSKFDY |
| DKK1-289 | 1109 | GFTFHKYG | 1523 | IGRHGGRT | 1937 | AKAGSGFDY |
| DKK1-290 | 1110 | GFTFSSYW | 1524 | IGPSGTST | 1938 | AESFRSRYFDY |
| DKK1-291 | 1111 | GFTFGNYA | 1525 | IWPRGQKT | 1939 | ASLSRGY |
| DKK1-292 | 1112 | GFTFRSYT | 1526 | ISGGGADT | 1940 | AKLPKRGPRFDY |
| DKK1-293 | 1113 | GFTFSRYF | 1527 | ISGRGDNT | 1941 | AKRTENRGVSFDY |
| DKK1-294 | 1114 | GFTFNKYP | 1528 | IQQRGLKT | 1942 | ARWTSGLDY |
| DKK1-295 | 1115 | GFTFSRYF | 1529 | IDALGTDT | 1943 | AKGLRRFDY |
| DKK1-296 | 1116 | GFTFDRYR | 1530 | ISSTGFKT | 1944 | AKFRGRGFDY |
| DKK1-297 | 1117 | GFTFTHYS | 1531 | INGTGGET | 1945 | ARLPKRGPRFDY |
| DKK1-298 | 1118 | GFTFSPYL | 1532 | IGPSGTST | 1946 | AKGRRIFDY |
| DKK1-299 | 1119 | GFTFSNYF | 1533 | IDDRGRYT | 1947 | ARGGDYGSGDY |

TABLE 4-continued

Variable Heavy Chain CDRs

| DKK1 Variant | SEQ ID NO | CDR1 Sequence | SEQ ID NO | CDR2 Sequence | SEQ ID NO | CDR3 Sequence |
|---|---|---|---|---|---|---|
| DKK1-300 | 1120 | GFTFRRYV | 1534 | ISGGGADT | 1948 | ARPPKRGPRFDY |
| DKK1-301 | 1121 | GFTFNKYP | 1535 | ISSSGGET | 1949 | AKRTRSKFDY |
| DKK1-302 | 1122 | GFTFKSYG | 1536 | IGRHGGRT | 1950 | ARGGDYGSGDY |
| DKK1-303 | 1123 | GFTFNKYP | 1537 | IGPSGGKT | 1951 | AKRTRSKFDY |
| DKK1-304 | 1124 | GFTFRRYV | 1538 | ISGGGADT | 1952 | ARPPKRGPRFDY |
| DKK1-305 | 1125 | GFTFEDET | 1539 | IISSGGLT | 1953 | AKGFRIFDY |
| DKK1-306 | 1126 | GFTFNKYP | 1540 | ITRSGST | 1954 | AKWSSRAFDY |
| DKK1-307 | 1127 | GFTFRRYV | 1541 | ISGGGADT | 1955 | AKHSKSSHRQSFDY |
| DKK1-308 | 1128 | GFTFNKYP | 1542 | ISPSGKKK | 1956 | AKLTGRFDY |
| DKK1-309 | 1129 | GFTFSRYF | 1543 | ISPSGKKK | 1957 | AKSGAYFDY |
| DKK1-310 | 1130 | GFTFNKYP | 1544 | IEGRGTET | 1958 | AKRTRSKFDY |
| DKK1-311 | 1131 | GFTFHKYG | 1545 | ISPSGKKK | 1959 | AKYPKNFDY |
| DKK1-312 | 1132 | GFTFRRYV | 1546 | ISPSGKKK | 1960 | AKGVRKKFDY |
| DKK1-313 | 1133 | GFTFRRYV | 1547 | ISGGGADT | 1961 | ARLPKRGPRFDY |
| DKK1-314 | 1134 | GFTFGNYA | 1548 | ISPIGPRT | 1962 | AKRTENRGVSFDY |
| DKK1-315 | 1135 | GFTLDYLA | 1549 | ISPSGKKK | 1963 | AKYTGRWEPFDY |
| DKK1-316 | 1136 | GFTFTHYS | 1550 | ISGGGADT | 1964 | ARLPKRGPRFDY |
| DKK1-317 | 1137 | GFTFRRYV | 1551 | ITGTGGET | 1965 | ARLPKRGPRFDY |
| DKK1-318 | 1138 | GFTFRRYV | 1552 | ISPSGHGT | 1966 | ARRTGREYGGGWYFDY |
| DKK1-319 | 1139 | GFTFPVYN | 1553 | ISESGTTT | 1967 | AKNRAKFDY |
| DKK1-320 | 1140 | GFTFRRYV | 1554 | ISGGGADT | 1968 | ARLPKRGPRFDY |
| DKK1-321 | 1141 | GFSFSAYA | 1555 | ISTSGGST | 1969 | ARGRAGADY |
| DKK1-322 | 1142 | GFTFSRFA | 1556 | ISGSGAYT | 1970 | ARDIAAASFDY |
| DKK1-323 | 1143 | GFTFTSYA | 1557 | VSGSGGTT | 1971 | AISYHFDYYFDY |
| DKK1-324 | 1144 | GFTFSSYA | 1558 | ISGGGAT | 1972 | ARECSGGSCSYYYGMDV |
| DKK1-325 | 1145 | GSTFNNYA | 1559 | ISGSGSTT | 1973 | ARLAVSTSDYYYYGMDV |
| DKK1-326 | 1146 | GFTFGRFA | 1560 | ITGSGTST | 1974 | ARDDRVRFSPVRRWFDP |
| DKK1-327 | 1147 | GFTFSKYA | 1561 | ISATGGST | 1975 | ARVRSSSWYGDY |
| DKK1-328 | 1148 | GFTFSRYA | 1562 | ISGSGVTT | 1976 | ARKTGGHYPFDY |
| DKK1-329 | 1149 | GFTFSRSA | 1563 | ISASGANT | 1977 | ARDQARYYGMDV |
| DKK1-330 | 1150 | GFTFRNYA | 1564 | ITSSGGST | 1978 | ASGLRARNGFDI |
| DKK1-331 | 1151 | GFTFSNYA | 1565 | ISGSGGST | 1979 | ARGAILAY |
| DKK1-332 | 1152 | GFTFSSYA | 1566 | VSGTGGTT | 1980 | ARDVGFGELHP |
| DKK1-333 | 1153 | GFTFSSYA | 1567 | ISGSGYST | 1981 | ARGRTGTLYGMDV |
| DKK1-334 | 1154 | GFSFNNYA | 1568 | ISGGGSNT | 1982 | ARVAASGSYYRAFDQ |
| DKK1-335 | 1155 | GFTFRRYA | 1569 | ISSSGGNT | 1983 | ARDRGFGWFDP |
| DKK1-336 | 1156 | GFTFRSYG | 1570 | ISGSGGRT | 1984 | AKVSYDSSGYYYDAFDI |
| DKK1-337 | 1157 | GFTFANYA | 1571 | ISGSGGSA | 1985 | ARSGSFLSFDS |

TABLE 4-continued

Variable Heavy Chain CDRs

| DKK1 Variant | SEQ ID NO | CDR1 Sequence | SEQ ID NO | CDR2 Sequence | SEQ ID NO | CDR3 Sequence |
|---|---|---|---|---|---|---|
| DKK1-338 | 1158 | GFTFGRFA | 1572 | ISGSGGRT | 1986 | ARVDYKKKSYYNAMDA |
| DKK1-339 | 1159 | GFTFRTSA | 1573 | ISSGGGGT | 1987 | ARGPRGRGAFDV |
| DKK1-340 | 1160 | GFTFSSYA | 1574 | ISGSGGST | 1988 | ARDDRVRFSPVRRWFDP |
| DKK1-341 | 1161 | GIHLSSYA | 1575 | ISGGGGT | 1989 | ARGGHVGIRRPFDV |
| DKK1-342 | 1162 | GFTFSKYA | 1576 | ISGSGGTT | 1990 | ARHAHGAGSYPFDY |
| DKK1-343 | 1163 | GFPFSSYA | 1577 | ISGSGGRT | 1991 | GRAPRKYYGMDV |
| DKK1-344 | 1164 | GFSFSAYA | 1578 | ISGRDTST | 1992 | ARVPLRGSGRLSFDY |
| DKK1-345 | 1165 | GSPFSNYA | 1579 | ISGSGGST | 1993 | ARAPRSPILGVRRGLDP |
| DKK1-346 | 1166 | GFSFSGYA | 1580 | ISGSSGRT | 1994 | VRGGTRGLGY |
| DKK1-347 | 1167 | GFTFRTYG | 1581 | ISGSGETT | 1995 | ARLDHDSSGFYEAFDV |
| DKK1-348 | 1168 | GLTFSRYA | 1582 | ISGRGGNT | 1996 | ARGGMRLGKSYYYYGMDV |
| DKK1-349 | 1169 | GFAFSTSA | 1583 | ISASGGST | 1997 | ARLSVARGAYGMDV |
| DKK1-350 | 1170 | GFTFGAYA | 1584 | ISGSGART | 1998 | ARRGRPPQYYFDS |
| DKK1-351 | 1171 | GFTFRRYA | 1585 | VSGSGGTT | 1999 | ARGWEPGIAAN |
| DKK1-352 | 1172 | GFTFSKHA | 1586 | ISGSGDTT | 2000 | ARHQYSGSGSFRY |
| DKK1-353 | 1173 | GFTFRRSA | 1587 | IGGSGDNT | 2001 | AKHRGSFWFDP |
| DKK1-354 | 1174 | GFSFRSYA | 1588 | ISGSGGNT | 2002 | TTMFGSGTFYTGFDF |
| DKK1-355 | 1175 | GFTFSSSS | 1589 | ISGSGGTT | 2003 | ARAGARFVGFDY |
| DKK1-356 | 1176 | GFTFSRFA | 1590 | ISGSGRNT | 2004 | ATFNPVGLFY |
| DKK1-357 | 1177 | GFSFSTYA | 1591 | ISGSAVST | 2005 | ARSGSFLSFDS |
| DKK1-358 | 1178 | GFTFSRYT | 1592 | VSGSGGRT | 2006 | ARSRNGRWFDP |
| DKK1-359 | 1179 | GLTFRSYA | 1593 | ISGSGGST | 2007 | ARGASFDS |
| DKK1-360 | 1180 | GFTFSNYA | 1594 | ISGSGART | 2008 | ARGRQRQRSTPLGRY |
| DKK1-361 | 1181 | GFNFRDYA | 1595 | ISGRGSV | 2009 | ARGGDWVAFDY |
| DKK1-362 | 1182 | GFTFSGYV | 1596 | ISGSGGRT | 2010 | ARRKGPTYGMDV |
| DKK1-363 | 1183 | GFTFSTFA | 1597 | LSGSGGRT | 2011 | ARVTRYQGWLSHFDY |
| DKK1-364 | 1184 | GFTLSTYA | 1598 | ISTSGGST | 2012 | ARVFVSSGWYDGMDV |
| DKK1-365 | 1185 | GLTFNNYA | 1599 | ISGSGART | 2013 | ARGASLDV |
| DKK1-366 | 1186 | GFTFGRYA | 1600 | ISGSGTTT | 2014 | ARAIGGRTAY |
| DKK1-367 | 1187 | GFSFSAYA | 1601 | ISGRDTST | 2015 | ARVPLRGSGRLSFDY |
| DKK1-368 | 1188 | GFTFGRYA | 1602 | ITASGGST | 2016 | ARVVTAMGYYYGMDV |
| DKK1-369 | 1189 | GFTFSNYG | 1603 | ISAGGGNT | 2017 | ARDLGMRGPYYYYYGMDV |
| DKK1-370 | 1190 | GFTFSYYG | 1604 | ISGGGAGT | 2018 | VASRNYLLDF |
| DKK1-371 | 1191 | GFTFTKYA | 1605 | ISGRGGST | 2019 | ARGDLTVTRKYDS |
| DKK1-372 | 1192 | GFTFRSYG | 1606 | ISRSGGNT | 2020 | ARTYSYGSFDY |
| DKK1-373 | 1193 | GFNFRSYA | 1607 | ISGSGTTT | 2021 | ASWRAAPFDY |
| DKK1-374 | 1194 | GFSFSAYA | 1608 | ISGRDTST | 2022 | ARVPLRGSGRLSFDY |

TABLE 4-continued

Variable Heavy Chain CDRs

| DKK1 Variant | SEQ ID NO | CDR1 Sequence | SEQ ID NO | CDR2 Sequence | SEQ ID NO | CDR3 Sequence |
|---|---|---|---|---|---|---|
| DKK1-375 | 1195 | GFTFGNYA | 1609 | ITGSGGST | 2023 | AKGKFHLDP |
| DKK1-376 | 1196 | GFSFSSYA | 1610 | ISGRGGST | 2024 | TTDYGAIMDV |
| DKK1-377 | 1197 | GFTFGRFA | 1611 | ISGSGTST | 2025 | ARDSRNYFGMGV |
| DKK1-378 | 1198 | GFTFGNYA | 1612 | ISRSGGNT | 2026 | GRDGTRFGAFDI |
| DKK1-379 | 1199 | GFTFNKFA | 1613 | ISGSGSRT | 2027 | ARGRSWYNH |
| DKK1-380 | 1200 | GLTFSSYA | 1614 | ISGSGGNT | 2028 | ARFQPRPLRLFDY |
| DKK1-381 | 1201 | GFTLRSYA | 1615 | ISGSGGYT | 2029 | ARASYGSGSYPLIH |
| DKK1-382 | 1202 | GFTFSSFA | 1616 | VSGSGGST | 2030 | AGHRSNIGWDV |
| DKK1-383 | 1203 | GSTFSSYA | 1617 | ISASGGRT | 2031 | ARDDRVRFSPVRRWFDP |
| DKK1-384 | 1204 | GFTFRRSA | 1618 | ISGSGSGT | 2032 | ARSARGRWFDP |
| DKK1-385 | 1205 | GFTFAGYA | 1619 | ISRSGDRT | 2033 | AKGQRAHQQLVRGAMDV |
| DKK1-386 | 1206 | GFTFRTFA | 1620 | ISASGGTT | 2034 | AHRRRSKFWSGFGV |
| DKK1-387 | 1207 | GFTFSRYA | 1621 | ISGSGVTT | 2035 | ARKTGGHYPFDY |
| DKK1-388 | 1208 | GFTFDNYA | 1622 | ISGSGGSI | 2036 | VKGAPAGYLDS |
| DKK1-389 | 1209 | GFRFSSYA | 1623 | ISGRGGST | 2037 | ARHNRERRAFDI |
| DKK1-390 | 1210 | GFTFRSYA | 1624 | ISGGGGTT | 2038 | ARDSRVRGTHDYYYYGMDV |
| DKK1-391 | 1211 | GFTFSKFA | 1625 | ISASGGRT | 2039 | ARGSLRFTP |
| DKK1-392 | 1212 | GFTFSSSG | 1626 | ISPSGGST | 2040 | ARLSADRVFAFDI |
| DKK1-393 | 1213 | GFSFSSFA | 1627 | ISGSGDVT | 2041 | AGHRSNIGWDV |
| DKK1-394 | 1214 | GFTFGRFA | 1628 | ITGSGTST | 2042 | ARVPLRGSGRLSFDY |
| DKK1-395 | 1215 | GFGFSSYA | 1629 | ITGSGGNT | 2043 | AKSRRPRYSGFAFES |
| DKK1-396 | 1216 | GVTFRNYA | 1630 | ISASGGSP | 2044 | ARDTSVGWFDP |
| DKK1-397 | 1217 | GFTFRNYA | 1631 | ISGGGGRT | 2045 | VRDLTRRAAMDV |
| DKK1-398 | 1218 | GFTFRSSA | 1632 | ISGSGRST | 2046 | ARNGAGSHYYAMDV |
| DKK1-399 | 1219 | GFTFSRFA | 1633 | ISGSGGRT | 2047 | ASSKVTRSALDY |
| DKK1-400 | 1220 | GFTFGNYA | 1634 | ISGSGSST | 2048 | GRESGRGSGT |
| DKK1-401 | 1221 | GFTYSSYA | 1635 | ISGSGGST | 2049 | ARERELYYFYYGMDV |
| DKK1-402 | 1222 | GFTFSTYG | 1636 | ITGSGGST | 2050 | ARHHNRRSSLDY |
| DKK1-403 | 1223 | GFTFSSSG | 1637 | ISSTGGTT | 2051 | ARRGRRQLRYYYGMDV |
| DKK1-404 | 1224 | GFSFSSSA | 1638 | ISGSGGTT | 2052 | ARARRRSFDW |
| DKK1-405 | 1225 | GFTFSRYA | 1639 | ISGGRVST | 2053 | ARSLRGNAFDI |
| DKK1-406 | 1226 | GFTFSGYA | 1640 | IRGSGGST | 2054 | AKDLQSRGY |
| DKK1-407 | 1227 | GFTFNKFA | 1641 | ISVSGGNT | 2055 | ARHSRLAALLA |
| DKK1-408 | 1228 | GFTFSSHV | 1642 | ISGSGAGT | 2056 | AVTGTTGWFDP |
| DKK1-409 | 1229 | GFTFGRYA | 1643 | ISSSRGST | 2057 | ARVGIAGRGMDV |
| DKK1-410 | 1230 | GFTFNTYG | 1644 | ISGRRT | 2058 | ARVSRGYPRRSDS |
| DKK1-411 | 1231 | GFTVSSYA | 1645 | ISGGGGTT | 2059 | VRSSNWKFDQ |
| DKK1-412 | 1232 | GFTFSRSA | 1646 | ISASGANT | 2060 | ARDQARYYGMDV |

TABLE 4-continued

Variable Heavy Chain CDRs

| DKK1 Variant | SEQ ID NO | CDR1 Sequence | SEQ ID NO | CDR2 Sequence | SEQ ID NO | CDR3 Sequence |
|---|---|---|---|---|---|---|
| DKK1-413 | 1233 | GFTFRSYD | 1647 | ISGSGVTT | 2061 | ARGRRLDY |
| DKK1-414 | 1234 | GFAFTTYA | 1648 | ISGSGSTT | 2062 | ARSGSFLSFDS |
| DKK1-415 | 1235 | GFTFSSYD | 1649 | ISGSGRNT | 2063 | ARGGGASNWFDP |
| DKK1-416 | 1236 | GFSFSAYA | 1650 | ISGRDTST | 2064 | ARVPLRGSGRLSFDY |
| DKK1-417 | 1237 | GFTFSRFA | 1651 | ISGTGSST | 2065 | ARVPGN |
| DKK1-418 | 1238 | GIPFSSR | 1652 | SRSGTG | 2066 | GNGGRTYGHSRARYD |
| DKK1-419 | 1239 | GGIYRVN | 1653 | NWSGGS | 2067 | GNGGRKYGHHRARYD |
| DKK1-420 | 1240 | GFLMYDR | 1654 | SRTGSS | 2068 | GNGGRKYGHHRARYD |
| DKK1-421 | 1241 | GRTFSRF | 1655 | SARGM | 2069 | GNGGRTYGHSRARYE |
| DKK1-422 | 1242 | GTTFRIN | 1656 | NWNGGS | 2070 | GNGGRQYGHSRARYD |
| DKK1-423 | 1243 | GRTFSNN | 1657 | LSGGS | 2071 | GNGGRNYGHSRARYD |
| DKK1-424 | 1244 | GRTFSDI | 1658 | NWSGAR | 2072 | APRPKRVSVQYFSTSSNYD |
| DKK1-425 | 1245 | GHTYNTY | 1659 | LRGGS | 2073 | GNGGRHYGHSRARYD |
| DKK1-426 | 1246 | GRSLYDR | 1660 | SRTGSS | 2074 | GNGGRSYGHSRARYD |
| DKK1-427 | 1247 | GRTFNNY | 1661 | SWSTGS | 2075 | EGGYSGTYYYTGDFD |
| DKK1-428 | 1248 | GRTLYSY | 1662 | SWSAGS | 2076 | GNGGSKYGHSRARYD |
| DKK1-429 | 1249 | GTFRDY | 1663 | YGTGGEL | 2077 | GNGGRQYGHSRARYD |
| DKK1-430 | 1250 | GGGTFGSY | 1664 | TWNGTR | 2078 | APRPKRVSVSYFSTASNYD |
| DKK1-431 | 1251 | GRTFSNY | 1665 | SWSGGS | 2079 | GNGGRTYGHSRARYD |
| DKK1-432 | 1252 | GRTFTNY | 1666 | SRGGSA | 2080 | GNGGRHYGHSRARYD |
| DKK1-433 | 1253 | GRTFSTH | 1667 | TRLGV | 2081 | GNGGRAYGYSRARYE |
| DKK1-434 | 1254 | GRSFSMY | 1668 | SRDGAA | 2082 | GNGGRLYGHSRARYD |
| DKK1-435 | 1255 | GLTFRNY | 1669 | SWSLSR | 2083 | APRPKRASVQYFSTSSNYD |
| DKK1-436 | 1256 | GFTFDDR | 1670 | RWSGGI | 2084 | GNGGRSYGHSRARYD |
| DKK1-437 | 1257 | GRTFSS | 1671 | NWSGAS | 2085 | GNGGRYYNHSRTRYE |
| DKK1-438 | 1258 | GHTFNTY | 1672 | NSGGSY | 2086 | GNGGRNYGHSRARYE |
| DKK1-439 | 1259 | GRIF | 1673 | SGSGVY | 2087 | GNGGRYYGHSRARYD |
| DKK1-440 | 1260 | GRSFSEY | 1674 | SRDGAA | 2088 | GNGGRKYGHHRARYD |
| DKK1-441 | 1261 | GFNSGSY | 1675 | SWSLSR | 2089 | APRPKRVSVSYFSTASNYD |
| DKK1-442 | 1262 | GGTAY | 1676 | SWSLTR | 2090 | APRPKRVSVRYFSTSSNYD |
| DKK1-443 | 1263 | GRTFTSY | 1677 | SGSGDD | 2091 | GNGGRQYGHSRARYD |
| DKK1-444 | 1264 | GSTFRIN | 1678 | SASGS | 2092 | GNGGRTYGHSRARYE |
| DKK1-445 | 1265 | GGTLNNNPM | 1679 | NWSGAR | 2093 | APRPKRISVQYFTTSSNYD |
| DKK1-446 | 1266 | GRTFSTY | 1680 | GTRGA | 2094 | GNGGRQYGHSRARYD |
| DKK1-447 | 1267 | GRTFNSY | 1681 | TRLGV | 2095 | GNGGRYYGHSRARYD |
| DKK1-448 | 1268 | GIPFSSR | 1682 | GWYGS | 2096 | GNGGRQYGHSRARYD |
| DKK1-449 | 1269 | GIDVNRN | 1683 | SWSGGR | 2097 | APRPKRVSVHYFSTSSNYD |

TABLE 4-continued

Variable Heavy Chain CDRs

| DKK1 Variant | SEQ ID NO | CDR1 Sequence | SEQ ID NO | CDR2 Sequence | SEQ ID NO | CDR3 Sequence |
|---|---|---|---|---|---|---|
| DKK1-450 | 1270 | GINFSRY | 1684 | DWSGSR | 2098 | APRPKRVSVSYFSTASNYD |
| DKK1-451 | 1271 | GGTLRGY | 1685 | DWSGSR | 2099 | APRPKYVSVRYFSTSSNYD |
| DKK1-452 | 1272 | GQTF | 1686 | NWNGDS | 2100 | GNGGRKYGHHRARYD |
| DKK1-453 | 1273 | GYTFRAY | 1687 | TSGGS | 2101 | GNGGRTYGHSRARYE |
| DKK1-454 | 1274 | GNIFTLN | 1688 | NSGGSY | 2102 | GNGGRKYGHHRARYD |
| DKK1-455 | 1275 | GFRMYDR | 1689 | SGRSGN | 2103 | GNGGRNYGHSRARYD |
| DKK1-456 | 1276 | GFTFSMW | 1690 | SRSGGS | 2104 | GNGGRYYNHSRTRYE |
| DKK1-457 | 1277 | GFTFRSY | 1691 | HTGGG | 2105 | GNGGRNYGHSRARYD |
| DKK1-458 | 1278 | GLPFSTK | 1692 | SSGGR | 2106 | GNGGRHYGHSRARYD |
| DKK1-459 | 1279 | GNIFRIN | 1693 | NSGGSS | 2107 | GNGGRAYGYSRARYE |
| DKK1-460 | 1280 | GGTFGHY | 1694 | SWSLTR | 2108 | APRPKRVSFSYFSTSSNYE |
| DKK1-461 | 1281 | GRTFNSY | 1695 | TWGGST | 2109 | GNGGRSYGHSRARYD |
| DKK1-462 | 1282 | GITFRRY | 1696 | NWGGS | 2110 | GNGGRAYGYSRARYE |
| DKK1-463 | 1283 | GRTFSYN | 1697 | SIGGR | 2111 | GNGGRSYGHSRARYD |
| DKK1-464 | 1284 | GRTFSSL | 1698 | RSSGG | 2112 | GNGGRTYGHSRARYE |
| DKK1-465 | 1285 | GPTFSTN | 1699 | YSGVRSGVS | 2113 | GNGGRHYGHSRARYD |
| DKK1-466 | 1286 | GRTFSNY | 1700 | YGTGGEL | 2114 | GNGGRKYGHHRARYD |
| DKK1-467 | 1287 | GRAIGSY | 1701 | TFSGAR | 2115 | APRPKRASVQYFSTSSNYD |
| DKK1-468 | 1288 | GRTLSRN | 1702 | RSGA | 2116 | GNGGRHYGHSRARYD |
| DKK1-469 | 1289 | GRTFIGY | 1703 | KFSGGT | 2117 | GNGGRYYGHSRARYD |
| DKK1-470 | 1290 | GRTISNY | 1704 | SWRGGS | 2118 | APRPKYVSVSYFSTSSNYD |
| DKK1-471 | 1291 | GRTISNY | 1705 | SWALSR | 2119 | APRPKRVSFSYFSTSSNYE |
| DKK1-472 | 1292 | GTFTSY | 1706 | SWTGGS | 2120 | GNGGRYYNHSRTRYE |
| DKK1-473 | 1293 | GRSFSMY | 1707 | SWSGGS | 2121 | EGGYSGTYYYTGDFD |
| DKK1-474 | 1294 | GLTFRNY | 1708 | NWSGAR | 2122 | APRPKSISVRYFSTSSNYE |
| DKK1-475 | 1295 | GFTFSSY | 1709 | SADGSD | 2123 | GKRYGYYD |
| DKK1-476 | 1296 | GRTHSIY | 1710 | RWGTTD | 2124 | APRPTRVSVRYFSTRSNYN |
| DKK1-477 | 1297 | GFSLDYV | 1711 | KPSGDT | 2125 | YLSFYSDYEVYD |
| DKK1-478 | 1298 | GSIFRVN | 1712 | SMSGAN | 2126 | GNGGRQYGHSRARYD |
| DKK1-479 | 1299 | GRTFSSL | 1713 | NWSGGN | 2127 | GNGGRKYGHHRARYD |
| DKK1-480 | 1300 | GFLMYDR | 1714 | SRTGSS | 2128 | GNGGRAYGYSRARYE |
| DKK1-481 | 1301 | GDISSY | 1715 | TWNGGTH | 2129 | GNGGRKYGHHRARYD |
| DKK1-482 | 1302 | GRTHSIY | 1716 | NWNGDS | 2130 | GNGGRTYGHSRARYE |
| DKK1-483 | 1303 | GIPFSSR | 1717 | SRSGTG | 2131 | GNGGRAYGYSRARYE |
| DKK1-484 | 1304 | GRTFSNY | 1718 | VNGGS | 2132 | GNGGRAYGYSRARYE |
| DKK1-485 | 1305 | GMTTIG | 1719 | SWDGGN | 2133 | GNGGRQYGHSRARYD |
| DKK1-486 | 1306 | GRASGDY | 1720 | SWRGGN | 2134 | APRPKRVSFSYFSTSSNYE |
| DKK1-487 | 1307 | GRTFSSY | 1721 | LSGGS | 2135 | GNGGRAYGYSRARYE |

TABLE 4-continued

Variable Heavy Chain CDRs

| DKK1 Variant | SEQ ID NO | CDR1 Sequence | SEQ ID NO | CDR2 Sequence | SEQ ID NO | CDR3 Sequence |
|---|---|---|---|---|---|---|
| DKK1-488 | 1308 | GRTFSEV | 1722 | HWSGGS | 2136 | GNGGRSYGHSRARYD |
| DKK1-489 | 1309 | GSTFSIN | 1723 | TPRGL | 2137 | GNGGRAYGYSRARYE |
| DKK1-490 | 1310 | GRTF | 1724 | IWRGGS | 2138 | GNGGRQYGHSRARYD |
| DKK1-491 | 1311 | GGTFSSY | 1725 | SWSGSA | 2139 | GNGGRSYGHSRARYD |
| DKK1-492 | 1312 | GRTFSNF | 1726 | LRGGS | 2140 | APRPKRVSVSYFSTASNYD |
| DKK1-493 | 1313 | GGTFSRY | 1727 | SWSLTR | 2141 | APRPKRVSVQYFVTSSNYD |
| DKK1-494 | 1314 | GRTLSRS | 1728 | RIKDGS | 2142 | GNGGRQYGHSRARYD |
| DKK1-495 | 1315 | GRTFSSG | 1729 | SRSGTL | 2143 | APRPKRVSVQYFSTSSNYD |
| DKK1-496 | 1316 | GRTFNSY | 1730 | NVGGG | 2144 | GNGGRTYGHSRARYD |
| DKK1-497 | 1317 | GYTLKNYY | 1731 | SRSGGT | 2145 | APRPKRASVQYFSTSSNYD |
| DKK1-498 | 1318 | GHTFNTY | 1732 | SYSG | 2146 | GNGGRAYGYSRARYE |
| DKK1-499 | 1319 | GFTFDDR | 1733 | STSGTR | 2147 | GNGGRQYGHSRARYD |
| DKK1-500 | 1320 | GRTLSSY | 1734 | GTSGP | 2148 | GNGGRTYGHSRARYE |
| DKK1-501 | 1321 | GRIFTNT | 1735 | SWGGGL | 2149 | GNGGSRYGHSRARYD |
| DKK1-502 | 1322 | GRIF | 1736 | SWTAGT | 2150 | GNGGRNYGHSRARYD |
| DKK1-503 | 1323 | GNIFTRH | 1737 | NTGGS | 2151 | GNGGRTYGHSRARYE |
| DKK1-504 | 1324 | GRTFSNY | 1738 | SWSSGN | 2152 | GNGGRQYGHSRARYD |
| DKK1-505 | 1325 | GRTFTSY | 1739 | GTHGT | 2153 | GNGGRQYGHSRARYD |
| DKK1-506 | | GQT | 1740 | SRSG | 2154 | GNGGRAYGYSRARYE |
| DKK1-507 | 1327 | GRSFSEY | 1741 | TWSGDM | 2155 | GNGGRHYGHSRARYD |
| DKK1-508 | 1328 | GRSFSSY | 1742 | NTAGW | 2156 | GNGGRSYGHSRARYD |
| DKK1-509 | 1329 | GLTFRNY | 1743 | SWSGGK | 2157 | APRPKRISVSYFSTTSNYD |
| DKK1-510 | 1330 | GSTFSSY | 1744 | HTGG | 2158 | GNGGRQYGHSRARYD |
| DKK1-511 | 1331 | GIDVNRN | 1745 | SWSGGT | 2159 | APRPKRVSVSYFSTASNYD |
| DKK1-512 | 1332 | GGTFNVY | 1746 | NRSGKS | 2160 | APRPKRVSVRYFSTSSNYD |

TABLE 5

Variable Heavy Chain Domain Sequences

| DKK1 Variant | SEQ ID NO | VH Sequence |
|---|---|---|
| DKK1-1 | 295 | EVQLVESGGGLVQPGGSLRLSCAASGRTFSRFAMGWFRQAPGKEREGVASITSGGTTNYADSVKGRFTISADNSKNTAYLQMNSLKPEDTAVYYCAADDGARGSWGQGTLVTVSS |
| DKK1-2 | 296 | EVQLVESGGGLVQPGGSLRLSCAASGSAFSSTVMGWFRQAPGKEREFVATINSLGGTSYADSVKGRFTISADNSKNTAYLQMNSLKPEDTAVYYCAAAYSGHFSGRVSDFLWGQGTLVTVSS |
| DKK1-3 | 297 | EVQLVESGGGLVQPGGSLRLSCAASGSTFSTYAMGWFRQAPGKEREFVASINWGGGNTYYADSVKGRFTISADNSKNTAYLQMNSLKPEDTAVYYCAAKKVSFGDWGQGTLVTVSS |
| DKK1-4 | 298 | EVQLVESGGGLVQPGGSLRLSCAASGNIFRINAMGWFRQAPGKERELVAAISRSGGSTNYADSVKGRFTISADNSKNTAYLQMNSLKPEDTAVYYCAKDKNGPWGQGTLVTVSS |

TABLE 5-continued

Variable Heavy Chain Domain Sequences

| DKK1 Variant | SEQ ID NO | VH Sequence |
|---|---|---|
| DKK1-5 | 299 | EVQLVESGGGLVQPGGSLRLSCAASGGLTFSTYAMGWFRQAPGKEREFVAAVSWSGGNTYYADSVKGRFTISADNSKNTAYLQMNSLKPEDTAVYYCAAEIGYYSGGTYYSSEAWGQGTLVTVSS |
| DKK1-6 | 300 | EVQLVESGGGLVQPGGSLRLSCAASGIPFSTRTMGWFRQAPGKEREFVAAISSGATTLYADSVKGRFTISADNSKNTAYLQMNSLKPEDTAVYYCAAGNGGRAYGYSRARYEWGQGTLVTVSS |
| DKK1-7 | 301 | EVQLVESGGGLVQPGGSLRLSCAASGISGSVFSRTPMGWFRQAPGKEREFVAALSKDGARTYYADSVKGRFTISADNSKNTAYLQMNSLKPEDTAVYYCARDLVGTDAFDIWGQGTLVTVSS |
| DKK1-8 | 302 | EVQLVESGGGLVQPGGSLRLSCAASGFTFSNYAMGWFRQAPGKEREFVAAISWSDGSTYYADSVKGRFTISADNSKNTAYLQMNSLKPEDTAVYYCAAEGGYSGTYYYTGDFDWGQGTLVTVSS |
| DKK1-9 | 303 | EVQLVESGGGLVQPGGSLRLSCAASGRSFSMYAMGWFRQAPGKERELVAAISWSGGSTVYADSVKGRFTISADNSKNTAYLQMNSLKPEDTAVYYCAAEGGYSGTYYYTGDFDWGQGTLVTVSS |
| DKK1-10 | 304 | EVQLVESGGGLVQPGGSLRLSCAASGRTISNYAMGWFRQAPGKEREFVAAISWRGGSTYYADSVKGRFTISADNSKNTAYLQMNSLKPEDTAVYYCAAAPRPKYVSVSYFSTSSNYDWGQGTLVTVSS |
| DKK1-11 | 305 | EVQLVESGGGLVQPGGSLRLSCAASGPTVDAYAMGWFRQAPGKEREFVSAISWSGSATFYADSVKGRFTISADNSKNTAYLQMNSLKPEDTAVYYCAAAPRPKRVSVRYFSTSSNYDWGQGTLVTVSS |
| DKK1-12 | 306 | EVQLVESGGGLVQPGGSLRLSCAASGRTFNSRPMGWFRQAPGKEREFVAAISSSASSTYYADSVKGRFTISADNSKNTAYLQMNSLKPEDTAVYYCAAGNGGRLYGHSRARYDWGQGTLVTVSS |
| DKK1-13 | 307 | EVQLVESGGGLVQPGGSLRLSCAASGFLMYDRAMGWFRQAPGKEREIVAAISRTGSSIYYADSVKGRFTISADNSKNTAYLQMNSLKPEDTAVYYCAAGNGGRKYGHHRARYDWGQGTLVTVSS |
| DKK1-14 | 308 | EVQLVESGGGLVQPGGSLRLSCAASGSIFSRLAMGWFRQAPGKEREFVAAISSSGISTIYADSVKGRFTISADNSKNTAYLQMNSLKPEDTAVYYCARGQRGRWLEPLTGWGQGTLVTVSS |
| DKK1-15 | 309 | EVQLVESGGGLVQPGGSLRLSCAASGFTFGTTTMGWFRQAPGKERELVAAITSGGGTTYYADSVKGRFTISADNSKNTAYLQMNSLKPEDTAVYYCAKDLAAAGYYYYYGMDVWGQGTLVTVSS |
| DKK1-16 | 310 | EVQLVESGGGLVQPGGSLRLSCAASGNIFTRNVMGWFRQAPGKEREFVGAINWSGGNTVYADSVKGRFTISADNSKNTAYLQMNSLKPEDTAVYYCARHDHNNRGLDYWGQGTLVTVSS |
| DKK1-17 | 311 | EVQLVESGGGLVQPGGSLRLSCAASGGTFSRYAMGWFRQAPGKEREFVAGISWTLGRTYYADSVKGRFTISADNSKNTAYLQMNSLKPEDTAVYYCARDPFGKWGQGTLVTVSS |
| DKK1-18 | 312 | EVQLVESGGGLVQPGGSLRLSCAASGITFRFKAMGWFRQAPGKEREFVAAINRSGRSTRYADSVKGRFTISADNSKNTAYLQMNSLKPEDTAVYYCAAESHGSTSPRNPLQYDWGQGTLVTVSS |
| DKK1-19 | 313 | EVQLVESGGGLVQPGGSLRLSCAASGRTYGMGWFRQAPGKEREFVAGISWTLGRTYYADSVKGRFTISADNSKNTAYLQMNSLKPEDTAVYYCASDESDAANWGQGTLVTVSS |
| DKK1-20 | 314 | EVQLVESGGGLVQPGGSLRLSCAASGPTFSIYDMGWFRQAPGKEREFVTGSNTGGTTYADSVKGRFTISADNSKNTAYLQMNSLKPEDTAVYYCATCTDFEYDWGQGTLVTVSS |
| DKK1-21 | 315 | EVQLVESGGGLVQPGGSLRLSCAASGIPSSIRAMGWFRQAPGKEREWVSGISISDSSTYYADSVKGRFTISADNSKNTAYLQMNSLKPEDTAVYYCAAGKRYGYYDWGQGTLVTVSS |
| DKK1-22 | 316 | EVQLVESGGGLVQPGGSLRLSCAASGSTLSINAMGWFRQAPGKERELVAAISWSGGTAYADSVKGRFTISADNSKNTAYLQMNSLKPEDTAVYYCAAQSRYRSNYYDHDKYAWGQGTLVTVSS |
| DKK1-23 | 317 | EVQLVESGGGLVQPGGSLRLSCAASGYNFSTFCMGWFRQAPGKEREWVAAISGGGSTMYADSVKGRFTISADNSKNTAYLQMNSLKPEDTAVYYCAASKWYGGFGDTDIEWGQGTLVTVSS |
| DKK1-24 | 318 | EVQLVESGGGLVQPGGSLRLSCAASGSSFSAYGMGWFRQAPGKEREFVAGISWTLGRTYYADSVKGRFTISADNSKNTAYLQMNSLKPEDTAVYYCAADGVPEYSDYASGPVWGQGTLVTVSS |
| DKK1-25 | 319 | EVQLVESGGGLVQPGGSLRLSCAASGSTSRSYGMGWFRQAPGKEREFVAGISWTLGRTYYADSVKGRFTISADNSKNTAYLQMNSLKPEDTAVYYCARDPSGKWGQGTLVTVSS |
| DKK1-26 | 320 | EVQLVESGGGLVQPGGSLRLSCAASGFSLDYYGMGWFRQAPGKEREVVASIRWNAKPYYADSVKGRFTISADNSKNTAYLQMNSLKPEDTAVYYCAAGKRYGYYDWGQGTLVTVSS |
| DKK1-27 | 321 | EVQLVESGGGLVQPGGSLRLSCAASGRTFSNYAMGWFRQAPGKEREWVASISTSGKTTYYADSVKGRFTISADNSKNTAYLQMNSLKPEDTAVYYCAAGNGGRNYGHSRARYEWGQGTLVTVSS |
| DKK1-28 | 322 | EVQLVESGGGLVQPGGSLRLSCAASGLTTVYTMGWFRQAPGKEREFVAAISWYVSTTFYADSVKGRFTISADNSKNTAYLQMNSLKPEDTAVYYCAAEGGYSGTYYYTGDFDWGQGTLVTVSS |
| DKK1-29 | 323 | EVQLVESGGGLVQPGGSLRLSCAASGSIGGLNAMGWFRQAPGKEREFVAAINYSGRSTVYADSVKGRFTISADNSKNTAYLQMNSLKPEDTAVYYCAAGAGRDRGFSRAQYAWGQGTLVTVSS |

TABLE 5-continued

Variable Heavy Chain Domain Sequences

| DKK1 Variant | SEQ ID NO | VH Sequence |
|---|---|---|
| DKK1-30 | 324 | EVQLVESGGGLVQPGGSLRLSCAASGRTFSKYAMGWFRQAPGKEREFVAAISWSGESTYYADSVKGRFTISADNSKNTAYLQMNSLKPEDTAVYYCAAAPRPKRVSVSYFYTSSNYDWGQGTLVTVSS |
| DKK1-31 | 325 | EVQLVESGGGLVQPGGSLRLSCAASGRTLSRSAMGWFRQAPGKERELVAAISWSGGSTYYADSVKGRFTISADNSKNTAYLQMNSLKPEDTAVYYCAAGNGGRTYGHSRARYEWGQGTLVTVSS |
| DKK1-32 | 326 | EVQLVESGGGLVQPGGSLRLSCAASGRTFSNGPMGWFRQAPGKEREFVAAISRGGKISHYADSVKGRFTISADNSKNTAYLQMNSLKPEDTAVYYCAAGNGGRYYGHSRARYDWGQGTLVTVSS |
| DKK1-33 | 327 | EVQLVESGGGLVQPGGSLRLSCAASGRSLNTYTMGWFRQAPGKERELVAVIISGGSTAYADSVKGRFTISADNSKNTAYLQMNSLKPEDTAVYYCAAGNGGRSYGHSRARYDWGQGTLVTVSS |
| DKK1-34 | 328 | EVQLVESGGGLVQPGGSLRLSCAASGFTFDDRAMGWFRQAPGKEREFVAAISWSGGSTYYADSVKGRFTISADNSKNTAYLQMNSLKPEDTAVYYCAAAPRPKRVSVSYFYTSSNYDWGQGTLVTVSS |
| DKK1-35 | 329 | EVQLVESGGGLVQPGGSLRLSCAASGRTFTTYPMGWFRQAPGKEREFVAAISSSGSSTVYADSVKGRFTISADNSKNTAYLQMNSLKPEDTAVYYCAAGNGGRQYGHSRARYDWGQGTLVTVSS |
| DKK1-36 | 330 | EVQLVESGGGLVQPGGSLRLSCAASGIPSTLRAMGWFRQAPGKEREFVAAINWSGASTVYADSVKGRFTISADNSKNTAYLQMNSLKPEDTAVYYCAAGNGGRQYGHSRARYDWGQGTLVTVSS |
| DKK1-37 | 331 | EVQLVESGGGLVQPGGSLRLSCAASGRTFSSYSMGWFRQAPGKEREFIAAINLSSGSTYYADSVKGRFTISADNSKNTAYLQMNSLKPEDTAVYYCAAGNGGRNYGHSRARYEWGQGTLVTVSS |
| DKK1-38 | 332 | EVQLVESGGGLVQPGGSLRLSCAASGTSFSIGAMGWFRQAPGKEREWVSSISPGGLFPYYADSVKGRFTISADNSKNTAYLQMNSLKPEDTAVYYCAARDAIVGVTDTSGYRWGQGTLVTVSS |
| DKK1-39 | 333 | EVQLVESGGGLVQPGGSLRLSCAASGTVFSISDMGWFRQAPGKEREWVSAISPGGGYTVYADSVKGRFTISADNSKNTAYLQMNSLKPEDTAVYYCARSSWFDCGVQGRDLGNEYDWGQGTLVTVSS |
| DKK1-40 | 334 | EVQLVESGGGLVQPGGSLRLSCAASGRTISSFRMGWFRQAPGKEREFVAAISRGGNVTPYADSVKGRFTISADNSKNTAYLQMNSLKPEDTAVYYCAANSDSGFDSYSVWAAYEWGQGTLVTVSS |
| DKK1-41 | 335 | EVQLVESGGGLVQPGGSLRLSCAASGRTLSRSAMGWFRQAPGKERELVAAISWSGGSTYYADSVKGRFTISADNSKNTAYLQMNSLKPEDTAVYYCAAGNGGRTYGHSRARYEWGQGTLVTVSS |
| DKK1-42 | 336 | EVQLVESGGGLVQPGGSLRLSCAASGRTFSSLPMGWFRQAPGKERELVAAITSGGRTYADSVKGRFTISADNSKNTAYLQMNSLKPEDTAVYYCAAGNGGRTYGHSRARYEWGQGTLVTVSS |
| DKK1-43 | 337 | EVQLVESGGGLVQPGGSLRLSCAASGTSFSVGAMGWFRQAPGKEREFVGAVSWSGGTTVYADSVKGRFTISADNSKNTAYLQMNSLKPEDTAVYYCAAGNGGRQYGHSRARYDWGQGTLVTVSS |
| DKK1-44 | 338 | EVQLVESGGGLVQPGGSLRLSCAASGRGAMGWFRQAPGKEREFVAAINRSGKSTYYADSVKGRFTISADNSKNTAYLQMNSLKPEDTAVYYCAAGNGGRSYGHSRARYDWGQGTLVTVSS |
| DKK1-45 | 339 | EVQLVESGGGLVQPGGSLRLSCAASGRTFSNFAMGWFRQAPGKEREFVAAISATGSTYYADSVKGRFTISADNSKNTAYLQMNSLKPEDTAVYYCAAGNGGRQYGHSRARYDWGQGTLVTVSS |
| DKK1-46 | 340 | EVQLVESGGGLVQPGGSLRLSCAASGRTLSSITMGWFRQAPGKERELVATITRAGSTNYADSVKGRFTISADNSKNTAYLQMNSLKPEDTAVYYCAAGNGGRYYGHSRARYDWGQGTLVTVSS |
| DKK1-47 | 341 | EVQLVESGGGLVQPGGSLRLSCAASGRTFSSLPMGWFRQAPGKERELVASISSGGSTYYADSVKGRFTISADNSKNTAYLQMNSLKPEDTAVYYCAAGNGGRTYGHSRARYDWGQGTLVTVSS |
| DKK1-48 | 342 | EVQLVESGGGLVQPGGSLRLSCAASGRSFGNFPMGWFRQAPGKERELVAAVTSGGSTYYADSVKGRFTISADNSKNTAYLQMNSLKPEDTAVYYCAAGNGGRSYGHSRARYDWGQGTLVTVSS |
| DKK1-49 | 343 | EVQLVESGGGLVQPGGSLRLSCAASGFTFTNYAMGWFRQAPGKEREVVAVVNWSGRRTYYADSVKGRFTISADNSKNTAYLQMNSLKPEDTAVYYCAAAPRPKRVSVQYFSTSSNYDWGQGTLVTVSS |
| DKK1-50 | 344 | EVQLVESGGGLVQPGGSLRLSCAASGRTFSLYTMGWFRQAPGKEREFVAAINRSGKSTYYADSVKGRFTISADNSKNTAYLQMNSLKPEDTAVYYCAAGNGGRQYGHSRARYDWGQGTLVTVSS |
| DKK1-51 | 345 | EVQLVESGGGLVQPGGSLRLSCAASGRTFSTSAMGWFRQAPGKEREFVAVINRSGKTTYYADSVKGRFTISADNSKNTAYLQMNSLKPEDTAVYYCAAGNGGRAYGYSRARYEWGQGTLVTVSS |
| DKK1-52 | 346 | EVQLVESGGGLVQPGGSLRLSCAASGRTFSISAMGWFRQAPGKEREFVAAISPSGNTYYADSVKGRFTISADNSKNTAYLQMNSLKPEDTAVYYCAAGNGGRAYGYSRARYEWGQGTLVTVSS |
| DKK1-53 | 347 | EVQLVESGGGLVQPGGSLRLSCAASGRTFSSYPMGWFRQAPGKEREFVASISRSGTTYYADSVKGRFTISADNSKNTAYLQMNSLKPEDTAVYYCAAGNGGRTYGHSRARYEWGQGTLVTVSS |
| DKK1-54 | 348 | EVQLVESGGGLVQPGGSLRLSCAASGFTFDDRAMGWFRQAPGKEREFVAAISTGGTTVYADSVKGRFTISADNSKNTAYLQMNSLKPEDTAVYYCAAGNGGRTYGHSRARYEWGQGTLVTVSS |

TABLE 5-continued

Variable Heavy Chain Domain Sequences

| DKK1 Variant | SEQ ID NO | VH Sequence |
|---|---|---|
| DKK1-55 | 349 | EVQLVESGGGLVQPGGSLRLSCAASGFTFGDYAMGWFRQAPGKEREFVGAIDWSGRRITYADSVKGRFTISADNSKNTAYLQMNSLKPEDTAVYYCAAAPRPKRVSVSYFSTASNYDWGQGTLVTVSS |
| DKK1-56 | 350 | EVQLVESGGGLVQPGGSLRLSCAASGRTFSSLPMGWFRQAPGKERELVARISSSGGTTYYADSVKGRFTISADNSKNTAYLQMNSLKPEDTAVYYCAAGNGGRLYGHSRARYDWGQGTLVTVSS |
| DKK1-57 | 351 | EVQLVESGGGLVQPGGSLRLSCAASGSTFSKAVMGWFRQAPGKEREFVATITFSGARTHYADSVKGRFTISADNSKNTAYLQMNSLKPEDTAVYYCAAGNGGRTYGHSRARYDWGQGTLVTVSS |
| DKK1-58 | 352 | EVQLVESGGGLVQPGGSLRLSCAASGRRFSADVMGWFRQAPGKEREFVAAIRSGGTTLYADSVKGRFTISADNSKNTAYLQMNSLKPEDTAVYYCAAGNGGRQYGHSRARYDWGQGTLVTVSS |
| DKK1-59 | 353 | EVQLVESGGGLVQPGGSLRLSCAASGFTVSNYAMGWFRQAPGKEREFVAAISWSGGSTYYADSVKGRFTISADNSKNTAYLQMNSLKPEDTAVYYCAAAPRPKRVSVRYFSTSSNYDWGQGTLVTVSS |
| DKK1-60 | 354 | EVQLVESGGGLVQPGGSLRLSCAASGRAFSSSAMGWFRQAPGKEREFVAAINRGGKISHYADSVKGRFTISADNSKNTAYLQMNSLKPEDTAVYYCAAGNGGRLYGHSRARYDWGQGTLVTVSS |
| DKK1-61 | 355 | EVQLVESGGGLVQPGGSLRLSCAASGRTFSSNVMGWFRQAPGKEREFVSAISRSGGSTVYADSVKGRFTISADNSKNTAYLQMNSLKPEDTAVYYCAAGNGGRTYGHSRARYDWGQGTLVTVSS |
| DKK1-62 | 356 | EVQLVESGGGLVQPGGSLRLSCAASGRTFSYNPMGWFRQAPGKEREFVAAINRSGKSTYYADSVKGRFTISADNSKNTAYLQMNSLKPEDTAVYYCAAGNGGRHYGHSRARYDWGQGTLVTVSS |
| DKK1-63 | 357 | EVQLVESGGGLVQPGGSLRLSCAASGFRMYDRVMGWFRQAPGKEREFVATISRSGGRTYYADSVKGRFTISADNSKNTAYLQMNSLKPEDTAVYYCAAGNGGRLYGHSRARYDWGQGTLVTVSS |
| DKK1-64 | 358 | EVQLVESGGGLVQPGGSLRLSCAASGRTSSAYAMGWFRQAPGKEREFVAAISRSGASAYYADSVKGRFTISADNSKNTAYLQMNSLKPEDTAVYYCAAGNGGRSYGHSRARYDWGQGTLVTVSS |
| DKK1-65 | 359 | EVQLVESGGGLVQPGGSLRLSCAASGRTFSRFAMGWFRQAPGKERELVAAISARGMPAYADSVKGRFTISADNSKNTAYLQMNSLKPEDTAVYYCAAGNGGRTYGHSRARYEWGQGTLVTVSS |
| DKK1-66 | 360 | EVQLVESGGGLVQPGGSLRLSCAASGRTFSSYSMGWFRQAPGKEREFIAAINLSSGSTYYADSVKGRFTISADNSKNTAYLQMNSLKPEDTAVYYCAAGNGGRNYGHSRARYEWGQGTLVTVSS |
| DKK1-67 | 361 | EVQLVESGGGLVQPGGSLRLSCAASGRTFRSYPMGWFRQAPGKEREFVAAISMSGKETWYADSVKGRFTISADNSKNTAYLQMNSLKPEDTAVYYCAAGNGGRTYGHSRARYEWGQGTLVTVSS |
| DKK1-68 | 362 | EVQLVESGGGLVQPGGSLRLSCAASGRTFSNYAMGWFRQAPGKEREWVASISTSGKTTYYADSVKGRFTISADNSKNTAYLQMNSLKPEDTAVYYCAAGNGGRNYGHSRARYEWGQGTLVTVSS |
| DKK1-69 | 363 | EVQLVESGGGLVQPGGSLRLSCAASGRTFSSYPMGWFRQAPGKEREFVAAISRSGGSTVYADSVKGRFTISADNSKNTAYLQMNSLKPEDTAVYYCAAGNGGRHYGHSRARYDWGQGTLVTVSS |
| DKK1-70 | 364 | EVQLVESGGGLVQPGGSLRLSCAASGTSFSIGAMGWFRQAPGKERELLAAISRSGASAYYADSVKGRFTISADNSKNTAYLQMNSLKPEDTAVYYCAAGNGGRTYGHSRARYDWGQGTLVTVSS |
| DKK1-71 | 365 | EVQLVESGGGLVQPGGSLRLSCAASGRTISNAAMGWFRQAPGKERELVAVIRSGGTTLYADSVKGRFTISADNSKNTAYLQMNSLKPEDTAVYYCAAGNGGRQYGHSRARYDWGQGTLVTVSS |
| DKK1-72 | 366 | EVQLVESGGGLVQPGGSLRLSCAASGGIYRVNTMGWFRQAPGKEREFVAAINWSGGSTIYADSVKGRFTISADNSKNTAYLQMNSLKPEDTAVYYCAAGNGGRKYGHHRARYDWGQGTLVTVSS |
| DKK1-73 | 367 | EVQLVESGGGLVQPGGSLRLSCAASGRTFSSKTMGWFRQAPGKEREFVAAINWSGGLTVYADSVKGRFTISADNSKNTAYLQMNSLKPEDTAVYYCAAGNGGRAYGYSRARYEWGQGTLVTVSS |
| DKK1-74 | 368 | EVQLVESGGGLVQPGGSLRLSCAASGIPFSSRTMGWFRQAPGKEREFVAAISRSGTGTYYADSVKGRFTISADNSKNTAYLQMNSLKPEDTAVYYCAAGNGGRTYGHSRARYDWGQGTLVTVSS |
| DKK1-75 | 369 | EVQLVESGGGLVQPGGSLRLSCAASGPTVDAYAMGWFRQAPGKEREFVSAISWSGSATFYADSVKGRFTISADNSKNTAYLQMNSLKPEDTAVYYCAAAPRPKRVSVRYFSTSSNYDWGQGTLVTVSS |
| DKK1-76 | 370 | EVQLVESGGGLVQPGGSLRLSCAASGIPFSTRTMGWFRQAPGKEREFVAAISSGATTLYADSVKGRFTISADNSKNTAYLQMNSLKPEDTAVYYCAAGNGGRAYGYSRARYEWGQGTLVTVSS |
| DKK1-77 | 371 | EVQLVESGGGLVQPGGSLRLSCAASGRTFNSRPMGWFRQAPGKEREFVAAISSSASSTYYADSVKGRFTISADNSKNTAYLQMNSLKPEDTAVYYCAAGNGGRLYGHSRARYDWGQGTLVTVSS |
| DKK1-78 | 372 | EVQLVESGGGLVQPGGSLRLSCAASGFTFSSSPMGWFRQAPGKERELVAVILRGGSTNYADSVKGRFTISADNSKNTAYLQMNSLKPEDTAVYYCAAGNGGRHYGHSRARYDWGQGTLVTVSS |
| DKK1-79 | 373 | EVQLVESGGGLVQPGGSLRLSCAASSIGIAFSSRTMGWFRQAPGKEREFVAAVTRSGGKSYYADSVKGRFTISADNSKNTAYLQMNSLKPEDTAVYYCAAGNGGRTYGHSRARYEWGQGTLVTVSS |

TABLE 5-continued

Variable Heavy Chain Domain Sequences

| DKK1 Variant | SEQ ID NO | VH Sequence |
|---|---|---|
| DKK1-80 | 374 | EVQLVESGGGLVQPGGSLRLSCAASGFLMYDRAMGWFRQAPGKEREIVAAISRTGSSIYYADSVKGRFTISADNSKNTAYLQMNSLKPEDTAVYYCAAGNGGRKYGHHRARYDWGQGTLVTVSS |
| DKK1-81 | 375 | EVQLVESGGGLVQPGGSLRLSCAASGIAFQGYAMGWFRQAPGKERELVAAIDTNGGHTLYADSVKGRFTISADNSKNTAYLQMNSLKPEDTAVYYCAAEGGYRGTYYYTGDFDWGQGTLVTVSS |
| DKK1-82 | 376 | EVQLVESGGGLVQPGGSLRLSCAASGRTFSNTLMGWFRQAPGKEREWVARITSGGSTHYADNVKGRFTIITDNSKNTAYLLMISLKPQNTAEYYWSAGNGGRHYGHNRPRYDWCHGGLVTVIT |
| DKK1-83 | 377 | EVQLVESGGGLVQPGGSLRLSCAASGSTSSLRTMGWFRQAPGKEREFVAAISWSLSRTHYADSVKGRFTISADNSKNTAYLQMNSLKPEDTAVYYCAAPRPKRVSVSYFSTASNYDWGQGTLVTVSS |
| DKK1-84 | 378 | EVQLVESGGGLVQPGGSLRLSCAASGRTFTNYPMGWFRQAPGKEREFVAAINRGGSTTYYADSVKGRFTISADNSKNTAYLQMNSLKPEDTAVYYCAAGNRRRPYGYSHSRYDWGQGTLVTVSS |
| DKK1-85 | 379 | EVQLVESGGGLVQPGGSLRLSCAASGITFKRYVMGWFRQAPGKEREFVATITSRDGTTYYYADSVKGRFTISADNSKNTAYLQMNSLKPEDTAVYYWAAGNGGRNYGHSRSRYEWGQGTLVTVSS |
| DKK1-86 | 380 | EVQLVESGGGLVQPGGSLRLSCAASGRTFINYAMGWFRQAPGKEREFVAAIIWTGVSTYYADSVKGRFTIIADNSKNTAYLQMNSLKPEDTAVYYCAAPRPNRVSVRYFSTNNNYDWGQGTLVTVSS |
| DKK1-87 | 381 | EVQLVESGGGLVQPGGSLRLSCAASGRTFSGYTMGWFRQAPGKEREFVAAISWSGGSTYYADSVKGRFTISADNSKNTAYLQMNSLKPEDTAVYHCAAGNGGRHYGHSRARYDWGQGTLVTVSS |
| DKK1-88 | 382 | EVQLVESGGGLVQPGGSLRLSCAASGLTFSTYPMGWFRQAPGKERELVALIASNGNTHYADSVKGRFTISADNSKNTAYLQMNSLKPEDTAVYYCAAGNGGRAYGYSRARYEWGQGTLVTVSS |
| DKK1-89 | 383 | EVQLVESGGGLVQPGGSLRLSCAASGFTSDDYAMGWFRQAPGKEREFVAAISWSGGRTYYADSVKGRFTISADNSKNTAYLQMNSLKPEDTAVYYCAAPRPKRVSVRYFSTSSNYDWGQGTLVTVSS |
| DKK1-90 | 384 | EVQLVESGGGLVQPGGSLRLSCAASGRTFRSYAMGWFRQAPGKEREFVAAISWSPGRTHYADSVKGRFTISADNSKNTAYLQMNSLKPEDTAVYYCAAPRPKRISVQYFTTSSNYDWGQGTLVTVSS |
| DKK1-91 | 385 | EVQLVESGGGLVQPGGSLRLSCAASGFTVSSYTMGWFRQAPGKEREFVAAISWSGGRTYYADSVKGRFTISADNSKNTAYLQMNSLKPEDTAVYYCAAPRPKRVSFSYFSTSSNYEWGQGTLVTVSS |
| DKK1-92 | 386 | EVQLVESGGGLVQPGGSLRLSCAASGFGFGSYNMGWFRQAPGKEREFVAMISWTGGSTYYADSVKGRFTISADNSKNTAYLQMNSLKPEDTAVYYCAAPRPKRVSVRYFNTSSNYDWGQGTLVTVSS |
| DKK1-93 | 387 | EVQLVESGGGLVQPGGSLRLSCAASGRTFSRYPMGWFRQAPGKEREFVAAISWSGGSTVYADSVKGRFTISADNSKNTAYLQMNSLKPEDTAVYYCAAGNGGRYYNHSRTRYEWGQGTLVTVSS |
| DKK1-94 | 388 | EVQLVESGGGLVQPGGSLRLSCAASGRIFGGYAMGWFRQAPGKEREFVAAISWSGASAIYADSVKGRFTISADNSKNTAYLQMNSLKPEDTAVYYCAAGNGGSRYGHSRARYDWGQGTLVTVSS |
| DKK1-95 | 389 | EVQLVESGGGLVQPGGSLRLSCAASGSIENINAMGWFRQAPGKEREFVAAISSGGGITIYADSVKGRFTISADNSKNTAYLQMNSLKPEDTAVYYCAAGNGGRKYGHHRARYDWGQGTLVTVSS |
| DKK1-96 | 390 | EVQLVESGGGLVQPGGSLRLSCAASGFTSSFGNFPMGWFRQAPGKEREFVAAINWSSRSTVYADSVKGRFTISADNSKNTAYLQMNSLKPEDTAVYYCAAGNGGRQYGHSRARYDWGQGTLVTVSS |
| DKK1-97 | 391 | EVQLVESGGGLVQPGGSLRLSCAASGNIDRLYAMGWFRQAPGKEREFVAAISWSVSSTYYADSVKGRFTISADNSKNTAYLQMNSLKPEDTAVYYCAAEGGYSGTYYYTGDFDWGQGTLVTVSS |
| DKK1-98 | 392 | EVQLVESGGGLVQPGGSLRLSCAASGRTFSNFAMGWFRQAPGKEREFVAVILRGGSTNYADSVKGRFTISADNSKNTAYLQMNSLKPEDTAVYYCAAPRPKRVSVSYFSTASNYDWGQGTLVTVSS |

TABLE 6

Additional Variable Heavy Chain Domain Sequences

| DKK1 Variant | SEQ ID NO | VH Sequence |
|---|---|---|
| DKK1-99 | 394 | EVQLVESGGGLVQPGGSLRLSCAASGRTFSNFAMGWFRQAPGKEREFVAVILRGGSTNYADSVKGRFTISADNSKNTAYLQMNSLKPEDTAVYYCAAPRPKRVSVSYFSTASNYDWGQGTLVTVSS |
| DKK1-100 | 395 | EVQLVESGGGLVQPGGSLRLSCAASGNIDRLYAMGWFRQAPGKEREFVAAISWSVSSTYYADSVKGRFTISADNSKNTAYLQMNSLKPEDTAVYYCAAEGGYSGTYYYTGDFDWGQGTLVTVSS |

TABLE 6-continued

Additional Variable Heavy Chain Domain Sequences

| DKK1 Variant | SEQ ID NO | VH Sequence |
|---|---|---|
| DKK1-101 | 396 | EVQLVESGGGLVQPGGSLRLSCAASGFTFSSFGNFPMGWFRQAPGKEREFVAAINWSSRSTVYADSVKGRFTISADNSKNTAYLQMNSLKPEDTAVYYCAAGNGGRQYGHSRARYDWGQGTLVTVSS |
| DKK1-102 | 397 | EVQLVESGGGLVQPGGSLRLSCAASGSIENINAMGWFRQAPGKEREFVAAISSGGGITIYADSVKGRFTISADNSKNTAYLQMNSLKPEDTAVYYCAAGNGGRKYGHHRARYDWGQGTLVTVSS |
| DKK1-103 | 398 | EVQLVESGGGLVQPGGSLRLSCAASGRIFGGYAMGWFRQAPGKEREFVAAISWSGASAIYADSVKGRFTISADNSKNTAYLQMNSLKPEDTAVYYCAAGNGGSRYGHSRARYDWGQGTLVTVSS |
| DKK1-104 | 399 | EVQLVESGGGLVQPGGSLRLSCAASGRTFSRYPMGWFRQAPGKEREFVAAISWSGGSTVYADSVKGRFTISADNSKNTAYLQMNSLKPEDTAVYYCAAGNGGRYYNHSRTRYEWGQGTLVTVSS |
| DKK1-105 | 400 | EVQLVESGGGLVQPGGSLRLSCAASGFGFGSYNMGWFRQAPGKEREFVAMISWTGGSTYYADSVKGRFTISADNSKNTAYLQMNSLKPEDTAVYYCAAAPRPKRVSVRYFNTSSNYDWGQGTLVTVSS |
| DKK1-106 | 401 | EVQLVESGGGLVQPGGSLRLSCAASGFTVSSYTMGWFRQAPGKEREFVAAISWSGGRTYYADSVKGRFTISADNSKNTAYLQMNSLKPEDTAVYYCAAAPRPKRVSFSYFSTSSNYEWGQGTLVTVSS |
| DKK1-107 | 402 | EVQLVESGGGLVQPGGSLRLSCAASGRTFRSYAMGWFRQAPGKEREFVAAISWSPGRTHYADSVKGRFTISADNSKNTAYLQMNSLKPEDTAVYYCAAAPRPKRISVQYFTTSSNYDWGQGTLVTVSS |
| DKK1-108 | 403 | EVQLVESGGGLVQPGGSLRLSCAASGFTSDDYAMGWFRQAPGKEREFVAAISWSGGRTYYADSVKGRFTISADNSKNTAYLQMNSLKPEDTAVYYCAAAPRPKRVSVRYFSTSSNYDWGQGTLVTVSS |
| DKK1-109 | 404 | EVQLVESGGGLVQPGGSLRLSCAASGLTFSTYPMGWFRQAPGKERELVALIASNGNTHYADSVKGRFTISADNSKNTAYLQMNSLKPEDTAVYYCAAGNGGRAYGYSRARYEWGQGTLVTVSS |
| DKK1-110 | 405 | EVQLVESGGGLVQPGGSLRLSCAASGRTFSGYTMGWFRQAPGKEREFVAAISWSGGSTYYADSVKGRFTISADNSKNTAYLQMNSLKPEDTAVYHCAAGNGGRHYGHSRARYDWGQGTLVTVSS |
| DKK1-111 | 406 | EVQLVESGGGLVQPGGSLRLSCAASGRTFINYAMGWFRQAPGKEREFVAAIIWTGVSTYYADSVKGRFTIIADNSKNTAYLQMNSLKPEDTAVYYCAAAPRPNRVSVRYFSTNNNYDWGQGTLVTVSS |
| DKK1-112 | 407 | EVQLVESGGGLVQPGGSLRLSCAASGITFKRYVMGWFRQAPGKEREFVATITSRDGTTYYADSVKGRFTISADNSKNTAYLQMNSLKPEDTAVYYWAAGNGGRNYGHSRSRYEWGQGTLVTVSS |
| DKK1-113 | 408 | EVQLVESGGGLVQPGGSLRLSCAASGRTFTNYPMGWFRQAPGKEREFVAAINRGGSTTYYADSVKGRFTISADNSKNTAYLQMNSLKPEDTAVYYCAAGNRRRPYGYSHSRYDWGQGTLVTVSS |
| DKK1-114 | 409 | EVQLVESGGGLVQPGGSLRLSCAASGSTSSLRTMGWFRQAPGKEREFVAAISWSLSRTHYADSVKGRFTISADNSKNTAYLQMNSLKPEDTAVYYCAAAPRPKRVSVSYFSTASNYDWGQGTLVTVSS |
| DKK1-115 | 410 | EVQLVESGGGLVQPGGSLRLSCAASGRTFSNTLMGWFRQAPGKEREWVARITSGGSTHYADNVKGRFTIITDNSKNTAYLLMISLKPQNTAEYYWSAGNGGRHYGHNRPRYDWCHGGLVTVIT |
| DKK1-116 | 411 | EVQLVESGGGLVQPGGSLRLSCAASGIAFQGYAMGWFRQAPGKERELVAAIDTNGGHTLYADSVKGRFTISADNSKNTAYLQMNSLKPEDTAVYYCAAEGGYRGTYYYTGDFDWGQGTLVTVSS |
| DKK1-117 | 412 | EVQLVESGGGLVQPGGSLRLSCAASGFLMYDRAMGWFRQAPGKEREIVAAISRTGSSIYYADSVKGRFTISADNSKNTAYLQMNSLKPEDTAVYYCAAGNGGRKYGHHRARYDWGQGTLVTVSS |
| DKK1-118 | 413 | EVQLVESGGGLVQPGGSLRLSCAASSIGIAFSSRTMGWFRQAPGKEREFVAAVTRSGGKSYYADSVKGRFTISADNSKNTAYLQMNSLKPEDTAVYYCAAGNGGRTYGHSRARYEWGQGTLVTVSS |
| DKK1-119 | 414 | EVQLVESGGGLVQPGGSLRLSCAASGFTFSSSPMGWFRQAPGKERELVAVILRGGSTNYADSVKGRFTISADNSKNTAYLQMNSLKPEDTAVYYCAAGNGGRHYGHSRARYDWGQGTLVTVSS |
| DKK1-120 | 415 | EVQLVESGGGLVQPGGSLRLSCAASGRTFNSRPMGWFRQAPGKEREFVAAISSSASSTYYADSVKGRFTISADNSKNTAYLQMNSLKPEDTAVYYCAAGNGGRLYGHSRARYDWGQGTLVTVSS |
| DKK1-121 | 416 | EVQLVESGGGLVQPGGSLRLSCAASGIPFSTRTMGWFRQAPGKEREFVAAISSGATTLYADSVKGRFTISADNSKNTAYLQMNSLKPEDTAVYYCAAGNGGRAYGYSRARYEWGQGTLVTVSS |
| DKK1-122 | 417 | EVQLVESGGGLVQPGGSLRLSCAASGPTVDAYAMGWFRQAPGKEREFVSAISWSGSATFYADSVKGRFTISADNSKNTAYLQMNSLKPEDTAVYYCAAAPRPKRVSVRYFSTSSNYDWGQGTLVTVSS |
| DKK1-123 | 418 | EVQLVESGGGLVQPGGSLRLSCAASGIPFSSRTMGWFRQAPGKEREFVAAISRSGTGTYYADSVKGRFTISADNSKNTAYLQMNSLKPEDTAVYYCAAGNGGRTYGHSRARYDWGQGTLVTVSS |
| DKK1-124 | 419 | EVQLVESGGGLVQPGGSLRLSCAASGRTFSSKTMGWFRQAPGKEREFVAAINWSGGLTVYADSVKGRFTISADNSKNTAYLQMNSLKPEDTAVYYCAAGNGGRAYGYSRARYEWGQGTLVTVSS |
| DKK1-125 | 420 | EVQLVESGGGLVQPGGSLRLSCAASGGIYRVNTMGWFRQAPGKEREFVAAINWSGGSTIYADSVKGRFTISADNSKNTAYLQMNSLKPEDTAVYYCAAGNGGRKYGHHRARYDWGQGTLVTVSS |

TABLE 6-continued

Additional Variable Heavy Chain Domain Sequences

| DKK1 Variant | SEQ ID NO | VH Sequence |
|---|---|---|
| DKK1-126 | 421 | EVQLVESGGGLVQPGGSLRLSCAASGRTISNAAMGWFRQAPGKERELVAVIRSGGTTLYADSVK GRFTISADNSKNTAYLQMNSLKPEDTAVYYCAAGNGGRQYGHSRARYDWGQGTLVTVSS |
| DKK1-127 | 422 | EVQLVESGGGLVQPGGSLRLSCAASGTSFSIGAMGWFRQAPGKERELLAAISRSGASAYYADSV KGRFTISADNSKNTAYLQMNSLKPEDTAVYYCAAGNGGRTYGHSRARYDWGQGTLVTVSS |
| DKK1-128 | 423 | EVQLVESGGGLVQPGGSLRLSCAASGRTFSSYPMGWFRQAPGKEREFVAAISRSGGSTVYADSV KGRFTISADNSKNTAYLQMNSLKPEDTAVYYCAAGNGGRHYGHSRARYDWGQGTLVTVSS |
| DKK1-129 | 424 | EVQLVESGGGLVQPGGSLRLSCAASGRTFSNYAMGWFRQAPGKEREWVASISTSGKTTYYADS VKGRFTISADNSKNTAYLQMNSLKPEDTAVYYCAAGNGGRNYGHSRARYEWGQGTLVTVSS |
| DKK1-130 | 425 | EVQLVESGGGLVQPGGSLRLSCAASGRTFRSYPMGWFRQAPGKEREFVAAISMSGKETWYADS VKGRFTISADNSKNTAYLQMNSLKPEDTAVYYCAAGNGGRTYGHSRARYEWGQGTLVTVSS |
| DKK1-131 | 426 | EVQLVESGGGLVQPGGSLRLSCAASGRTFSSYSMGWFRQAPGKEREFIAAINLSSGSTYYADSVK GRFTISADNSKNTAYLQMNSLKPEDTAVYYCAAGNGGRNYGHSRARYEWGQGTLVTVSS |
| DKK1-132 | 427 | EVQLVESGGGLVQPGGSLRLSCAASGRTFSRFAMGWFRQAPGKERELVAAISARGMPAYADSV KGRFTISADNSKNTAYLQMNSLKPEDTAVYYCAAGNGGRTYGHSRARYEWGQGTLVTVSS |
| DKK1-133 | 428 | EVQLVESGGGLVQPGGSLRLSCAASGRTSSAYAMGWFRQAPGKEREFVAAISRSGASAYYADSV KGRFTISADNSKNTAYLQMNSLKPEDTAVYYCAAGNGGRSYGHSRARYDWGQGTLVTVSS |
| DKK1-134 | 429 | EVQLVESGGGLVQPGGSLRLSCAASGFRMYDRVMGWFRQAPGKEREFVATISRSGGRTYYADS VKGRFTISADNSKNTAYLQMNSLKPEDTAVYYCAAGNGGRLYGHSRARYDWGQGTLVTVSS |
| DKK1-135 | 430 | EVQLVESGGGLVQPGGSLRLSCAASGRTFSYNPMGWFRQAPGKEREFVAAINRSGKSTYYADSV KGRFTISADNSKNTAYLQMNSLKPEDTAVYYCAAGNGGRHYGHSRARYDWGQGTLVTVSS |
| DKK1-136 | 431 | EVQLVESGGGLVQPGGSLRLSCAASGRTFSSNVMGWFRQAPGKEREFVSAISRSGGSTVYADSV KGRFTISADNSKNTAYLQMNSLKPEDTAVYYCAAGNGGRTYGHSRARYDWGQGTLVTVSS |
| DKK1-137 | 432 | EVQLVESGGGLVQPGGSLRLSCAASGRAFSSSAMGWFRQAPGKEREFVAAINRGGKISHYADSV KGRFTISADNSKNTAYLQMNSLKPEDTAVYYCAAGNGGRLYGHSRARYDWGQGTLVTVSS |
| DKK1-138 | 433 | EVQLVESGGGLVQPGGSLRLSCAASGFTVSNYAMGWFRQAPGKEREFVAAISWSGGSTYYADS VKGRFTISADNSKNTAYLQMNSLKPEDTAVYYCAAAPRPKRVSVRYFSTSSNYDWGQGTLVTVSS |
| DKK1-139 | 434 | EVQLVESGGGLVQPGGSLRLSCAASGRRFSADVMGWFRQAPGKEREFVAAIRSGGTTLYADSV KGRFTISADNSKNTAYLQMNSLKPEDTAVYYCAAGNGGRQYGHSRARYDWGQGTLVTVSS |
| DKK1-140 | 435 | EVQLVESGGGLVQPGGSLRLSCAASGSTFSKAVMGWFRQAPGKEREFVATITFSGARTHYADSV KGRFTISADNSKNTAYLQMNSLKPEDTAVYYCAAGNGGRTYGHSRARYDWGQGTLVTVSS |
| DKK1-141 | 436 | EVQLVESGGGLVQPGGSLRLSCAASGRTFSSLPMGWFRQAPGKERELVARISSSGGTTYYADSV KGRFTISADNSKNTAYLQMNSLKPEDTAVYYCAAGNGGRLYGHSRARYDWGQGTLVTVSS |
| DKK1-142 | 437 | EVQLVESGGGLVQPGGSLRLSCAASGFTFGDYAMGWFRQAPGKEREFVGAIDWSGRRITYADS VKGRFTISADNSKNTAYLQMNSLKPEDTAVYYCAAAPRPKRVSVSYFSTASNYDWGQGTLVTVSS |
| DKK1-143 | 438 | EVQLVESGGGLVQPGGSLRLSCAASGFTFDDRAMGWFRQAPGKEREFVAAISTGGTTVYADSV KGRFTISADNSKNTAYLQMNSLKPEDTAVYYCAAGNGGRTYGHSRARYEWGQGTLVTVSS |
| DKK1-144 | 439 | EVQLVESGGGLVQPGGSLRLSCAASGRTFSSYPMGWFRQAPGKEREFVASISRSGTTYYADSVK GRFTISADNSKNTAYLQMNSLKPEDTAVYYCAAGNGGRTYGHSRARYEWGQGTLVTVSS |
| DKK1-145 | 440 | EVQLVESGGGLVQPGGSLRLSCAASGRTFSISAMGWFRQAPGKEREFVAAISPSGNTYYADSVK GRFTISADNSKNTAYLQMNSLKPEDTAVYYCAAGNGGRAYGYSRARYEWGQGTLVTVSS |
| DKK1-146 | 441 | EVQLVESGGGLVQPGGSLRLSCAASGRTFSTSAMGWFRQAPGKEREFVAVINRSGKTTYYADSV KGRFTISADNSKNTAYLQMNSLKPEDTAVYYCAAGNGGRAYGYSRARYEWGQGTLVTVSS |
| DKK1-147 | 442 | EVQLVESGGGLVQPGGSLRLSCAASGRTFSLYTMGWFRQAPGKEREFVAAINRSGKSTYYADSV KGRFTISADNSKNTAYLQMNSLKPEDTAVYYCAAGNGGRQYGHSRARYDWGQGTLVTVSS |
| DKK1-148 | 443 | EVQLVESGGGLVQPGGSLRLSCAASGFTFTNYAMGWFRQAPGKEREVVAVVNWSGRRTYYAD SVKGRFTISADNSKNTAYLQMNSLKPEDTAVYYCAAAPRPKRVSVQYFSTSSNYDWGQGTLVTVSS |
| DKK1-149 | 444 | EVQLVESGGGLVQPGGSLRLSCAASGRSFGNFPMGWFRQAPGKERELVAAVTSGGSTYYADSV KGRFTISADNSKNTAYLQMNSLKPEDTAVYYCAAGNGGRSYGHSRARYDWGQGTLVTVSS |

TABLE 6-continued

Additional Variable Heavy Chain Domain Sequences

| DKK1 Variant | SEQ ID NO | VH Sequence |
|---|---|---|
| DKK1-150 | 445 | EVQLVESGGGLVQPGGSLRLSCAASGRTFSSLPMGWFRQAPGKERELVASISSGGSTYYADSVK GRFTISADNSKNTAYLQMNSLKPEDTAVYYCAAGNGGRTYGHSRARYDWGQGTLVTVSS |
| DKK1-151 | 446 | EVQLVESGGGLVQPGGSLRLSCAASGRTLSSITMGWFRQAPGKERELVATITRAGSTNYADSVK GRFTISADNSKNTAYLQMNSLKPEDTAVYYCAAGNGGRYYGHSRARYDWGQGTLVTVSS |
| DKK1-152 | 447 | EVQLVESGGGLVQPGGSLRLSCAASGRTFSNFAMGWFRQAPGKEREFVAAISATGSTYYADSVK GRFTISADNSKNTAYLQMNSLKPEDTAVYYCAAGNGGRQYGHSRARYDWGQGTLVTVSS |
| DKK1-153 | 448 | EVQLVESGGGLVQPGGSLRLSCAASGRGAMGWFRQAPGKEREFVAAINRSGKSTYYADSVKGR FTISADNSKNTAYLQMNSLKPEDTAVYYCAAGNGGRSYGHSRARYDWGQGTLVTVSS |
| DKK1-154 | 449 | EVQLVESGGGLVQPGGSLRLSCAASGTSFSVGAMGWFRQAPGKEREFVGAVSWSGGTTVYADS VKGRFTISADNSKNTAYLQMNSLKPEDTAVYYCAAGNGGRQYGHSRARYDWGQGTLVTVSS |
| DKK1-155 | 450 | EVQLVESGGGLVQPGGSLRLSCAASGRTFSSLPMGWFRQAPGKERELVAAITSGGRTYADSVKG RFTISADNSKNTAYLQMNSLKPEDTAVYYCAAGNGGRTYGHSRARYEWGQGTLVTVSS |
| DKK1-156 | 451 | EVQLVESGGGLVQPGGSLRLSCAASGRTLSRSAMGWFRQAPGKERELVAAISWSGGSTYYADS VKGRFTISADNSKNTAYLQMNSLKPEDTAVYYCAAGNGGRTYGHSRARYEWGQGTLVTVSS |
| DKK1-157 | 452 | EVQLVESGGGLVQPGGSLRLSCAASGRTISNYAMGWFRQAPGKEREFVAAISWRGGSTYYADS VKGRFTISADNSKNTAYLQMNSLKPEDTAVYYCAAAPRPKYVSVSYFSTSSNYDWGQGTLVTVSS |
| DKK1-158 | 453 | EVQLVESGGGLVQPGGSLRLSCAASGHTFRGYVMGWFRQAPGKEREFVAAISGRSGNTYYADS VKGRFTISADNSKNTAYLQMNSLKPEDTAVYYCAAGNGGRLYGHSRARYDWGQGTLVTVSS |
| DKK1-159 | 454 | EVQLVESGGGLVQPGGSLRLSCAASGSIVRGNTMGWFRQAPGKEREFVAAISSSGSSTVYADSV KGRFTISADNSKNTAYLQMNSLKPEDTAVYYCAAGNGGRTYGHSRARYEWGQGTLVTVSS |
| DKK1-160 | 455 | EVQLVESGGGLVQPGGSLRLSCAASGRTFSSYPMGWFRQAPGKEREFVAAISRSGGSTLYADSV KGRFTISADNSKNTAYLQMNSLKPEDTAVYYCAAGNGGRTYGHSRARYEWGQGTLVTVSS |
| DKK1-161 | 456 | EVQLVESGGGLVQPGGSLRLSCAASGNIFGVNPMGWFRQAPGKEREFVAFISGTGGSTYYADSV KGRFTISADNSKNTAYLQMNSLKPEDTAVYYCAAGNGGRTYGHSRARYEWGQGTLVTVSS |
| DKK1-162 | 457 | EVQLVESGGGLVQPGGSLRLSCAASGHTFRGYAMGWFRQAPGKEREFVAAINRSGSSTVYADS VKGRFTISADNSKNTAYLQMNSLKPEDTAVYYCAAGNGGRAYGYSRARYEWGQGTLVTVSS |
| DKK1-163 | 458 | EVQLVESGGGLVQPGGSLRLSCAASGRTLRRYVMGWFRQAPGKERELVARIISDGNTYYADSVK GRFTISADNSKNTAYLQMNSLKPEDTAVYYCAAGNGGRQYGHSRARYDWGQGTLVTVSS |
| DKK1-164 | 459 | EVQLVESGGGLVQPGGSLRLSCAASGRALSSSVMGWFRQAPGKERELVALLWSGGRTLYADSV KGRFTISADNSKNTAYLQMNSLKPEDTAVYYCAAGNGGRYYGHSRARYDWGQGTLVTVSS |
| DKK1-165 | 460 | EVQLVESGGGLVQPGGSLRLSCAASGRTFSNGPMGWFRQAPGKEREWVASITSTGSTYADSVKG RFTISADNSKNTAYLQMNSLKPEDTAVYYCAAGNGGRLYGHSRARYDWGQGTLVTVSS |
| DKK1-166 | 461 | EVQLVESGGGLVQPGGSLRLSCAASGLTFGSAPMGWFRQAPGKERELVAAITSGGRTYADSVKG RFTISADNSKNTAYLQMNSLKPEDTAVYYCAAGNGGRQYGHSRARYDWGQGTLVTVSS |
| DKK1-167 | 462 | EVQLVESGGGLVQPGGSLRLSCAASGFTFGSTTMGWFRQAPGKEREFVAAVNWSGRRELYADS VKGRFTISADNSKNTAYLQMNSLKPEDTAVYYCAAAPRPKRVSVSYFYTSSNYDWGQGTLVTVSS |
| DKK1-168 | 463 | EVQLVESGGGLVQPGGSLRLSCAASGRFTSSSPMGWFRQAPGKERELVASITSGGRTSYADSVK GRFTISADNSKNTAYLQMNSLKPEDTAVYYCAAGNGGRAYGYSRARYEWGQGTLVTVSS |
| DKK1-169 | 464 | EVQLVESGGGLVQPGGSLRLSCAASGRTFNSRPMGWFRQAPGKERELVASITSDGSTYYADSVK GRFTISADNSKNTAYLQMNSLKPEDTAVYYCAAGNGGRQYGHSRARYDWGQGTLVTVSS |
| DKK1-170 | 465 | EVQLVESGGGLVQPGGSLRLSCAASGRTLSSVMGWFRQAPGKEREFVATISQRGRRYADSVKGR FTISADNSKNTAYLQMNSLKPEDTAVYYCAAGNGGRQYGHSRARYDWGQGTLVTVSS |
| DKK1-171 | 466 | EVQLVESGGGLVQPGGSLRLSCAASGGTFSRYAMGWFRQAPGKEREFVAAINRSGKSTYYADS VKGRFTISADNSKNTAYLQMNSLKPEDTAVYYCAAGNGGRQYGHSRARYDWGQGTLVTVSS |
| DKK1-172 | 467 | EVQLVESGGGLVQPGGSLRLSCAASGRTFNSRPMGWFRQAPGKERELVATISSGSTTYYADSVK GRFTISADNSKNTAYLQMNSLKPEDTAVYYCAAGNGGRSYGHSRARYDWGQGTLVTVSS |
| DKK1-173 | 468 | EVQLVESGGGLVQPGGSLRLSCAASGSTFRGAAMGWFRQAPGKEREFVAAITSAGGTTYYADS VKGRFTISADNSKNTAYLQMNSLKPEDTAVYYCAAGNGGRQYGHSRARYDWGQGTLVTVSS |

TABLE 6-continued

Additional Variable Heavy Chain Domain Sequences

| DKK1 Variant | SEQ ID NO | VH Sequence |
|---|---|---|
| DKK1-174 | 469 | EVQLVESGGGLVQPGGSLRLSCAASGSTFSKAVMGWFRQAPGKERELVAGILSSGATVYADSVKGRFTISADNSKNTAYLQMNSLKPEDTAVYYCAAGNGGRHYGHSRARYDWGQGTLVTVSS |
| DKK1-175 | 470 | EVQLVESGGGLVQPGGSLRLSCAASGTTFRINVMGWFRQAPGKEREFVGAISRSGGSTYYADSVKGRFTISADNSKNTAYLQMNSLKPEDTAVYYCAAGNGGRSYGHSRARYDWGQGTLVTVSS |
| DKK1-176 | 471 | EVQLVESGGGLVQPGGSLRLSCAASGFPVNRYSMGWFRQAPGKEREFVAAISRSGGSTYYADSVKGRFTISADNSKNTAYLQMNSLKPEDTAVYYCAAGNGGRQYGHSRARYDWGQGTLVTVSS |
| DKK1-177 | 472 | EVQLVESGGGLVQPGGSLRLSCAASGHTFNTYPMGWFRQAPGKERELVAAITSNGRPSYADSVKGRFTISADNSKNTAYLQMNSLKPEDTAVYYCAAGNGGRAYGYSRARYEWGQGTLVTVSS |
| DKK1-178 | 473 | EVQLVESGGGLVQPGGSLRLSCAASGRTFGRRAMGWFRQAPGKEREFVAAINWSGGSTVYADSVKGRFTISADNSKNTAYLQMNSLKPEDTAVYYCAAGNGGRHYGHSRARYDWGQGTLVTVSS |
| DKK1-179 | 474 | EVQLVESGGGLVQPGGSLRLSCAASGFTFSSYPMGWFRQAPGKEREFVALISRSGGTTFYADSVKGRFTISADNSKNTAYLQMNSLKPEDTAVYYCAAGNGGRNYGHSRARYDWGQGTLVTVSS |
| DKK1-180 | 475 | EVQLVESGGGLVQPGGSLRLSCAASGRTFSNFAMGWFRQAPGKERELVAFSSSGGRTIYADSVKGRFTISADNSKNTAYLQMNSLKPEDTAVYYCAAGNGGRHYGHSRARYDWGQGTLVTVSS |
| DKK1-181 | 476 | EVQLVESGGGLVQPGGSLRLSCAASGLTTVYTMGWFRQAPGKEREVVAAISRTGGSTYYADSVKGRFTISADNSKNTAYLQMNSLKPEDTAVYYCAAGNGGRTYGHSRARYEWGQGTLVTVSS |
| DKK1-182 | 477 | EVQLVESGGGLVQPGGSLRLSCAASGTTFRINVMGWFRQAPGKEREFVAAINRSGKSTYYADSVKGRFTISADNSKNTAYLQMNSLKPEDTAVYYCAAGNGGRQYGHSRARYDWGQGTLVTVSS |
| DKK1-183 | 478 | EVQLVESGGGLVQPGGSLRLSCAASGRTFSTHAMGWFRQAPGKEREFVAHITRLGVTYYADSVKGRFTISADNSKNTAYLQMNSLKPEDTAVYYCAAGNGGRAYGYSRARYEWGQGTLVTVSS |
| DKK1-184 | 479 | EVQLVESGGGLVQPGGSLRLSCAASGIPSTLRAMGWFRQAPGKEREFVAAINWSGASTVYADSVKGRFTISADNSKNTAYLQMNSLKPEDTAVYYCAAGNGGRQYGHSRARYDWGQGTLVTVSS |
| DKK1-185 | 480 | EVQLVESGGGLVQPGGSLRLSCAASGRTFSSYVMGWFRQAPGKEREFVAAIDWSGSRSYYADSVKGRFTISADNSKNTAYLQMNSLKPEDTAVYYCAAAPRPKRVSVSYFYTSSNYDWGQGTLVTVSS |
| DKK1-186 | 481 | EVQLVESGGGLVQPGGSLRLSCAASGRTFSDIAMGWFRQAPGKEREFVAAINWSGARTYYADSVKGRFTISADNSKNTAYLQMNSLKPEDTAVYYCAAAPRPKRVSVQYFSTSSNYDWGQGTLVTVSS |
| DKK1-187 | 482 | EVQLVESGGGLVQPGGSLRLSCAASGIPFSTRTMGWFRQAPGKEREFVAAISWSGGSTIYADSVKGRFTISADNSKNTAYLQMNSLKPEDTAVYYCAAGNGGRQYGHSRARYDWGQGTLVTVSS |
| DKK1-188 | 483 | EVQLVESGGGLVQPGGSLRLSCAASGFTFDEYAMGWFRQAPGKEREFVGAIDWSGRRITYADSVKGRFTISADNSKNTAYLQMNSLKPEDTAVYYCAAAPRPKRISVSYFSTSSNYDWGQGTLVTVSS |
| DKK1-189 | 484 | EVQLVESGGGLVQPGGSLRLSCAASGFTFSNYAMGWFRQAPGKEREFVAAISWSGGSTVYADSVKGRFTISADNSKNTAYLQMNSLKPEDTAVYYCAAAPRPKRVSFSYFSTSSNYEWGQGTLVTVSS |
| DKK1-190 | 485 | EVQLVESGGGLVQPGGSLRLSCAASGITFKRYAMGWFRQAPGKEREFVAAINWSGASTVYADSVKGRFTISADNSKNTAYLQMNSLKPEDTAVYYCAAGNGGRQYGHSRARYDWGQGTLVTVSS |
| DKK1-191 | 486 | EVQLVESGGGLVQPGGSLRLSCAASGFTFGHYAMGWFRQAPGKEREFVAAISWSLTRTHYADSVKGRFTISADNSKNTAYLQMNSLKPEDTAVYYCAAAPRPKRVSVQYFSTSSNYDWGQGTLVTVSS |
| DKK1-192 | 487 | EVQLVESGGGLVQPGGSLRLSCAASGSITSINPMGWFRQAPGKEREFVAAISRSGASAYYADSVKGRFTISADNSKNTAYLQMNSLKPEDTAVYYCAAGNGGRTYGHSRARYEWGQGTLVTVSS |
| DKK1-193 | 488 | EVQLVESGGGLVQPGGSLRLSCAASGGRIFSNYAMGWFRQAPGKEREFVAAISWSGGSTYYADSVKGRFTISADNSKNTAYLQMNSLKPEDTAVYYCAAAPRPKRVSVSYFSTASNYDWGQGTLVTVSS |
| DKK1-194 | 489 | EVQLVESGGGLVQPGGSLRLSCAASGRTFTMGWFRQAPGKEREFVAAINWRSGGSTYYADSVKGRFTISADNSKNTAYLQMNSLKPEDTAVYYCAAGNGGRTYGHSRARYEWGQGTLVTVSS |
| DKK1-195 | 490 | EVQLVESGGGLVQPGGSLRLSCAASGGTFNGRAMGWFRQAPGKEREFVAAISRSGGGIYYADSVKGRFTISADNSKNTAYLQMNSLKPEDTAVYYCAAGNGGRQYGHSRARYDWGQGTLVTVSS |
| DKK1-196 | 491 | EVQLVESGGGLVQPGGSLRLSCAASGFNFDDYAMGWFRQAPGKERELVAAISWSLSRTHYADSVKGRFTISADNSKNTAYLQMNSLKPEDTAVYYCAAAPRPKRVSVSYFSTASNYDWGQGTLVTVSS |
| DKK1-197 | 492 | EVQLVESGGGLVQPGGSLRLSCAASSIGIAFSSRTMGWFRQAPGKEREFVAAVTRSGGKSYYADSVKGRFTISADNSKNTAYLQMNSLKPEDTAVYYCAAGNGGRSYGHSRARYDWGQGTLVTVSS |
| DKK1-198 | 493 | EVQLVESGGGLVQPGGSLRLSCAASGSTFRINVMGWFRQAPGKEREFVAAISASGSALYADSVKGRFTISADNSKNTAYLQMNSLKPEDTAVYYCAAGNGGRTYGHSRARYEWGQGTLVTVSS |

TABLE 6-continued

Additional Variable Heavy Chain Domain Sequences

| DKK1 Variant | SEQ ID NO | VH Sequence |
|---|---|---|
| DKK1-199 | 494 | EVQLVESGGGLVQPGGSLRLSCAASGGIYRVNTMGWFRQAPGKEREFVAAINWSGGSTVYADSVKGRFTISADNSKNTAYLQMNSLKPEDTAVYYCAAGNGGRQYGHSRARYDWGQGTLVTVSS |
| DKK1-200 | 495 | EVQLVESGGGLVQPGGSLRLSCAASGRSLNTYTMGWFRQAPGKERELVAVIISGGSTAYADSVKGRFTISADNSKNTAYLQMNSLKPEDTAVYYCAAGNGGRSYGHSRARYDWGQGTLVTVSS |
| DKK1-201 | 496 | EVQLVESGGGLVQPGGSLRLSCAASGRTFSNYAMGWFRQAPGKEREWVASISTSGKTTYYADSVKGRFTISADNSKNTAYLQMNSLKPEDTAVYYCAAGNGGRQYGHSRARYDWGQGTLVTVSS |
| DKK1-202 | 497 | EVQLVESGGGLVQPGGSLRLSCAASGTTVRIRTMGWFRQAPGKEREFVAAINGGGNTYYADSVKGRFTISADNSKNTAYLQMNSLKPEDTAVYYCAAGNGGRQYGHSRARYDWGQGTLVTVSS |
| DKK1-203 | 498 | EVQLVESGGGLVQPGGSLRLSCAASGRTFSTYSMGWFRQAPGKEREFVAAINWSGSSTVYADSVKGRFTISADNSKNTAYLQMNSLKPEDTAVYYCAAGNGGRHYGHSRARYDWGQGTLVTVSS |
| DKK1-204 | 499 | EVQLVESGGGLVQPGGSLRLSCAASGIPFSTRTMGWFRQAPGKEREFVAAISSGATTLYADSVKGRFTISADNSKNTAYLQMNSLKPEDTAVYYCAAGNGGRHYGHSRARYDWGQGTLVTVSS |
| DKK1-205 | 500 | EVQLVESGGGLVQPGGSLRLSCAASGRTFSRYAMGWFRQAPGKEREFVALIRIKDGSIYYADSVKGRFTISADNSKNTAYLQMNSLKPEDTAVYYCAAGNGGRQYGHSRARYDWGQGTLVTVSS |
| DKK1-206 | 501 | EVQLVESGGGLVQPGGSLRLSCAASGHTFNTYPMGWFRQAPGKERELVAAISRSGGKLYYADSVKGRFTISADNSKNTAYLQMNSLKPEDTAVYYCAAGNGGRNYGHSRARYEWGQGTLVTVSS |
| DKK1-207 | 502 | EVQLVESGGGLVQPGGSLRLSCAASGRSFSEYAMGWFRQAPGKEREFLAAISRDGAATYYADSVKGRFTISADNSKNTAYLQMNSLKPEDTAVYYCAAGNGGRKYGHHRARYDWGQGTLVTVSS |
| DKK1-208 | 503 | EVQLVESGGGLVQPGGSLRLSCAASGRTFTTYPMGWFRQAPGKEREFVAAISSSGSSTVYADSVKGRFTISADNSKNTAYLQMNSLKPEDTAVYYCAAGNGGRQYGHSRARYDWGQGTLVTVSS |
| DKK1-209 | 504 | EVQLVESGGGLVQPGGSLRLSCAASGRTFSRYAMGWFRQAPGKEREFVAAISWSGGSTLYADSVKGRFTISADNSKNTAYLQMNSLKPEDTAVYYCAAGNGGRQYGHSRARYDWGQGTLVTVSS |
| DKK1-210 | 505 | EVQLVESGGGLVQPGGSLRLSCAASGSIFTINAMGWFRQAPGKERELVAAINWSGSSTVYADSVKGRFTISADNSKNTAYLQMNSLKPEDTAVYYCAAGNGGRKYGHHRARYDWGQGTLVTVSS |
| DKK1-211 | 506 | EVQLVESGGGLVQPGGSLRLSCAASGTSISNRVMGWFRQAPGKERELVAGISSGGNLKAYADSVKGRFTISADNSKNTAYLQMNSLKPEDTAVYYCAAGNGGRQYGHSRARYDWGQGTLVTVSS |
| DKK1-212 | 507 | EVQLLESGGGLVQPGGSLRLSCAASGFTFRRYVMGWVRQAPGKGLEWVSAIEGAGSDTYYADSVKGRFTISRDNSKNTLYLQMNSLRAEDTAVYYCAKQIPGRKWTANGRKDYWGQGTLVTVSS |
| DKK1-213 | 508 | EVQLLESGGGLVQPGGSLRLSCAASGFTFNKYPMMWVRQAPGKGLEWVSEISPSGKKKYYADSVKGRFTISRDNSKNTLYLQMNSLRAEDTAVYYCAKYPKNFDYWGQGTLVTVSS |
| DKK1-214 | 509 | EVQLLESGGGLVQPGGSLRLSCAASGFTFSSAAMSWVRQAPGKGLEWVAAISGGGADTYYADSVKGRFTISRDNSKNTLYLQMNSLRAEDTAVYYCARLPKRGPRFDYWGQGTLVTVSS |
| DKK1-215 | 510 | EVQLLESGGGLVQPGGSLRLSCAASGFTFNKYPMMWVRQAPGKGLEWVSAIQQRGLKTAYADSVKGRFTISRDNSKNTLYLQMNSLRAEDTAVYYCAKGIRGWIGHDTQPFDYWGQGTLVTVSS |
| DKK1-216 | 511 | EVQLLESGGGLVQPGGSLRLSCAASGFTFDRYRMMWVRQAPGKGLEWVSEISPSGKKKYYADSVKGRFTISRDNSKNTLYLQMNSLRAEDTAVYYCAKYPKNFDYWGQGTLVTVSS |
| DKK1-217 | 512 | EVQLLESGGGLVQPGGSLRLSCAASGFTSNNFAMTWVRQAPGKGLEWVAAISGGGADTYYADSVKGRFTISRDNSKNTLYLQMNSLRAEDTAVYYCAKLQKRGPRFDYWGQGTLVTVSS |
| DKK1-218 | 513 | EVQLLESGGGLVQPGGSLRLSCAASGFTFGNYAMAWVRQAPGKGLEWVSVISSSGGETSYADSVKGRFTISRDNSKNTLYLQMNSLRAEDTAVYYCVKAPLRSGGVDYWGQGTLVTVSS |
| DKK1-219 | 514 | EVQLLESGGGLVQPGGSLRLSCAASGFTFDRYRMMWVRQAPGKGLEWVSEISPSGKKKYYADSVKGRFTISRDNSKNTLYLQMNSLRAEDTAVYYCAKFPSTHGKFDYWGQGTLVTVSS |
| DKK1-220 | 515 | EVQLLESGGGLVQPGGSLRLSCAASGLTFPNYGMGWVRQAPGKGLEWVSSIDDRGRYTYYADSVKGRFTISRDNSKNTLYLQMNSLRAEDTAVYYCARVIAAAGAFDYWGQGTLVTVSS |
| DKK1-221 | 516 | EVQLLESGGGLVQPGGSLRLSCAASGFTFNKYPMMWVRQAPGKGLEWVGYISNSGSTSYNDSVKGRFTISRDNSKNTLYLQMNSLRAEDTAVYYCAKRTRSKFDYWGQGTLVTVSS |
| DKK1-222 | 517 | EVQLLESGGGLVQPGGSLRLSCAASGFTFTHYSMGWVRQAPGKGLEWVSGITRSGSTNYRDSVKGRFTISRDNSKNTLYLQMNSLRAEDTAVYYCAKRTENRGVSFDYWGQGTLVTVSS |

TABLE 6-continued

Additional Variable Heavy Chain Domain Sequences

| DKK1 Variant | SEQ ID NO | VH Sequence |
|---|---|---|
| DKK1-223 | 518 | EVQLLESGGGLVQPGGSLRLSCAASGFTFEEKEMIWVRQAPGKGLEWVSMISSSGLWTYYADSV KGRFTISRDNSKNTLYLQMNSLRAEDTAVYYCAKGWRRFDYWGQGTLVTVSS |
| DKK1-224 | 519 | EVQLLESGGGLVQPGGSLRLSCAASGFTFDRYRMMWVRQAPGKGLEWVSEISPSGKKKYYADS VKGRFTISRDNSKNTLYLQMNSLRAEDTAVYYCAKYTWNGYWGQGTLVTVSS |
| DKK1-225 | 520 | EVQLLESGGGLVQPGGSLRLSCAASGFTFHKYGMAWVRQAPGKGLEWVSEISPSGKKKYYADS VKGRFTISRDNSKNTLYLQMNSLRAEDTAVYYCASLSRGYWGQGTLVTVSS |
| DKK1-226 | 521 | EVQLLESGGGLVQPGGSLRLSCAASGFTFGNYAMAWVRQAPGKGLEWVSSIWPRGQKTYYADS VKGRFTISRDNSKNTLYLQMNSLRAEDTAVYYCAKFRGRGFDYWGQGTLVTVSS |
| DKK1-227 | 522 | EVQLLESGGGLVQPGGSLRLSCAASGFTFAKYKMWWVRQAPGKGLEWVSEISPSGKKKYYADS VKGRFTISRDNSKNTLYLQMNSLRAEDTAVYYCAKAHNAFDYWGQGTLVTVSS |
| DKK1-228 | 523 | EVQLLESGGGLVQPGGSLRLSCAASGFTFSSYFMSWVRQAPGKGLEWVSAISGGGADTYYADSV KGRFTISRDNSKNTLYLQMNSLRAEDTAVYYCARGNYFDYWGQGTLVTVSS |
| DKK1-229 | 524 | EVQLLESGGGLVQPGGSLRLSCAASGFTFDRYRMMWVRQAPGKGLEWVSSISGYGSTTYYADS VKGRFTISRDNSKNTLYLQMNSLRAEDTAVYYCAKFRGRGFDYWGQGTLVTVSS |
| DKK1-230 | 525 | EVQLLESGGGLVQPGGSLRLSCAASGFTFSRYAMNWVRQAPGKGLEWVSSIGANGAPTYYADS VKGRFTISRDNSKNTLYLQMNSLRAEDTAVYYCAKDKRYRGSQHYFDYWGQGTLVTVSS |
| DKK1-231 | 526 | EVQLLESGGGLVQPGGSLRLSCAASGFTFRSYTMGWVRQAPGKGLEWVSSISNSGGSTYYADSV KGRFTISRDNSKNTLYLQMNSLRAEDTAVYYCAKAGRKFDYWGQGTLVTVSS |
| DKK1-232 | 527 | EVQLLESGGGLVQPGGSLRLSCAASGFTFSDYDMSWVRQAPGKGLEWVSDIGASGSATSYADSV KGRFTISRDNSKNTLYLQMNSLRAEDTAVYYCAKQSGSEDHFDYWGQGTLVTVSS |
| DKK1-233 | 528 | EVQLLESGGGLVQPGGSLRLSCAASGFTFRRYVMGWVRQAPGKGLEWVSEISPSGKKKYYADS VKGRFTISRDNSKNTLYLQMNSLRAEDTAVYYCAKWRREGYTGSKFDYWGQGTLVTVSS |
| DKK1-234 | 529 | EVQLLESGGGLVQPGGSLRLSCAASGGFSLSRYMHWVRQAPGKGLEWVSTINQAGLRTYYADS VKGRFTISRDNSKNTLYLQMNSLRAEDTAVYYCAKSRTGRYFDYWGQGTLVTVSS |
| DKK1-235 | 530 | EVQLLESGGGLVQPGGSLRLSCAASGFTFHKYGMAWVRQAPGKGLEWVGYINPSRGYTYYADS VKGRFTISRDNSKNTLYLQMNSLRAEDTAVYYCAKGYRHFDYWGQGTLVTVSS |
| DKK1-236 | 531 | EVQLLESGGGLVQPGGSLRLSCAASGFTFNKYPMMWVRQAPGKGLEWVSVISSSGGETSYADS VKGRFTISRDNSKNTLYLQMNSLRAEDTAVYYCAKDLGQGFDYWGQGTLVTVSS |
| DKK1-237 | 532 | EVQLLESGGGLVQPGGSLRLSCAASGFTFNKYPMMWVRQAPGKGLEWVSYISSSGSSTYYADSV KGRFTISRDNSKNTLYLQMNSLRAEDTAVYYCAKRTRSKFDYWGQGTLVTVSS |
| DKK1-238 | 533 | EVQLLESGGGLVQPGGSLRLSCAASGFTFRRYVMGWVRQAPGKGLEWVAAISGGGADTYYADS VKGRFTISRDNSKNTLYLQMNSLRAEDTAVYYCAGLPKRGPRFDYWGQGTLVTVSS |
| DKK1-239 | 534 | EVQLLESGGGLVQPGGSLRLSCAASGFTFSRYAMNWVRQAPGKGLEWVSYIGPSGGKTYYADS VKGRFTISRDNSKNTLYLQMNSLRAEDTAVYYCARLPKRGPWFDYWGQGTLVTVSS |
| DKK1-240 | 535 | EVQLLESGGGLVQPGGSLRLSCAASGFTFRRYVMGWVRQAPGKGLEWVAAISGGGADTYYADS VKGRFTISRDNSKNTLYLQMNSLRAEDTAVYYCAKPSRRFDYWGQGTLVTVSS |
| DKK1-241 | 536 | EVQLLESGGGLVQPGGSLRLSCAASGFTFSSYVMIWVRQAPGKGLEWVSAIQQRGLKTAYADSV KGRFTISRDNSKNTLYLQMNSLRAEDTAVYYCARSGPYYFDYWGQGTLVTVSS |
| DKK1-242 | 537 | EVQLLESGGGLVQPGGSLRLSCAASGFTFEDYQMGWVRQAPGKGLEWVSAITGTGGETYYADS VKGRFTISRDNSKNTLYLQMNSLRAEDTAVYYCAKPGHRFDYWGQGTLVTVSS |
| DKK1-243 | 538 | EVQLLESGGGLVQPGGSLRLSCAASGFTFRRYVMGWVRQAPGKGLEWVSGIYPSGGSTVYADS VKGRFTISRDNSKNTLYLQMNSLRAEDTAVYYCAKDRYSQVHYALDYWGQGTLVTVSS |
| DKK1-244 | 539 | EVQLLESGGGLVQPGGSLRLSCAASGFTFKAYEIGWVRQAPGKGLEWVSGISPSGGITTYADSVK GRFTISRDNSKNTLYLQMNSLRAEDTAVYYCARHRAGSSGWYSDYWGQGTLVTVSS |
| DKK1-245 | 540 | EVQLLESGGGLVQPGGSLRLSCAASGFTFEVYTMAWVRQAPGKGLEWVSAISRGDNTYYADS VKGRFTISRDNSKNTLYLQMNSLRAEDTAVYYCAKRTENRGVSFDYWGQGTLVTVSS |
| DKK1-246 | 541 | EVQLLESGGGLVQPGGSLRLSCAASGFTFGNYSMAWVRQAPGKGLEWVSNIWPRGQKTYYADS VKGRFTISRDNSKNTLYLQMNSLRAEDTAVYYCAKVTGRGFDYWGQGTLVTVSS |
| DKK1-247 | 542 | EVQLLESGGGLVQPGGSLRLSCAASGFTFRRYVMGWVRQAPGKGLEWVADVNPNSGTSIYNDS VKGRFTISRDNSKNTLYLQMNSLRAEDTAVYYCAKGPGTRGDYWGQGTLVTVSS |

TABLE 6-continued

Additional Variable Heavy Chain Domain Sequences

| DKK1 Variant | SEQ ID NO | VH Sequence |
|---|---|---|
| DKK1-248 | 543 | EVQLLESGGGLVQPGGSLRLSCAASGFTFSNYGVSWVRQAPGKGLEWVSSISPSGGWTEYADSVKGRFTISRDNSKNTLYLQMNSLRAEDTAVYYCARYGAYFGLDYWGQGTLVTVSS |
| DKK1-249 | 544 | EVQLLESGGGLVQPGGSLRLSCAASGFTFAHEPMVWVRQAPGKGLEWVGKINYAGNTDYNDSVKGRFTISRDNSKNTLYLQMNSLRAEDTAVYYCAKKDYDYVWGSPYFDYWGQGTLVTVSS |
| DKK1-250 | 545 | EVQLLESGGGLVQPGGSLRLSCAASGFTFHESTMTWVRQAPGKGLEWVSVISSSGGETSYADSVKGRFTISRDNSKNTLYLQMNSLRAEDTAVYYCARIRVGPSGGAFDYWGQGTLVTVSS |
| DKK1-251 | 546 | EVQLLESGGGLVQPGGSLRLSCAASGFTFNKYPMMWVRQAPGKGLEWVSEISPSGKKKYYADSVKGRFTISRDNSKNTLYLQMNSLRAEDTAVYYCAKFPSSQFRFDYWGQGTLVTVSS |
| DKK1-252 | 547 | EVQLLESGGGLVQPGGSLRLSCAASGFTFNKYPMMWVRQAPGKGLEWVSEISPSGKKKYYADSVKGRFTISRDNSKNTLYLQMNSLRAEDTAVYYCAKYPKNFNYWGQGTLVTVSS |
| DKK1-253 | 548 | KVQLLESGGGLVQPGGSLRLSCAASGFTFHKYGMAWVRQAPGKGLEWVGKINYAGNTDYNDSVKGRFTISRDNSKNTLYLQMNSLRAEDTAVYYCAKDKRYRGSQHYFDYWGQGTLVTVSS |
| DKK1-254 | 549 | EVQLLESGGGLVQPGGSLRLSCAASGLTFPNYGMGWVRQAPGKGLEWVSEISPSGKKKYYADSVKGRFTISRDNSKNTLYLQMNSLRAEDTAVYYCAREGLWAFDYWGQGTLVTVSS |
| DKK1-255 | 550 | EVQLLESGGGLVQPGGSLRLSCAASGFTFKAYEIGWVRQAPGKGVEWGSGIIPNGGITTYADSVKGRFTISRDNSXNTLYLLMNSLIAEDAAVYYCGRHRAGSIGWYSDYWGQGTLVTVSS |
| DKK1-256 | 551 | EVQLLESGGGLVQPGGSLRLSCAASGFTFRRYVMGWVRQAPGKGLEWVSDIGASGSATSYADSVKGRFTISRDNSKNTLYLQMNSLRAEDTAVYYCAKRTRSKFDYWGQGTLVTVSS |
| DKK1-257 | 552 | EVQLLESGGGLVQPGGSLRLSCAASGFTFRRYVMGWVRQAPGKGLEWVAAISGGGADTYYADSVKGRFTISRDNSKNTLYLQMNSLRAEDTAVYYCAKGRRRFDYWGQGTLVTVSS |
| DKK1-258 | 553 | EVQLLESGGGLVQPGGSLRLSCAASGFTSNNFAMTWVRQAPGKGLEWVAAISGGGADTYYADSVKGRFTISRDNSKNTLYLQMNSLRAEDTAVYYCAKLQKRGPRFDYWGQGTLVTVSS |
| DKK1-259 | 554 | EVQLLESGGGLVQPGGSLRLSCAASGFTFGNYAMAWVRQAPGKGLEWVSTIWARGQKTYYADSVKGRFTISRDNSKNTLYLQMNSLRAEDTAVYYCAHLPGRGFEYWGRGTRTPVSS |
| DKK1-260 | 555 | EVQLLESGGGLVQPGGSLRLSCAASGFTFEDETMSWVRQAPGKGLEWVSAIISSGGLTYYADSVKGRFTISRDNSKNTLYLQMNSLRAEDTAVYYCAKGFRIFDYWGQGTLVTVSS |
| DKK1-261 | 556 | EVQLLESGGGLVQPGGSLRLSCAASGFTFSNSYISWVRQAPGKGLEWVSYITPKGDHTYYADSVKGRFTISRDNSKNTLYLQMNSLRAEDTAVYYCAKGARRFDYWGQGTLVTVSS |
| DKK1-262 | 557 | EVQLLESGGGLVQPGGSLRLSCAASGFTFSGYDMQWVRQAPGKGLEWVSSIGRHGGRTYYADSVKGRFTISRDNSKNTLYLQMNSLRAEDTAVYYCAKSLGRFDYWGQGTLVTVSS |
| DKK1-263 | 558 | EVQLLESGGGLVQPGGSLRLSCAASGFTFRRYVMGWVRQAPGKGLEWVSAIEGAGSDTYYADSVKGRFTISRDNSKNTLYLQMNSLRAEDTAVYYCARLPKRGPRFDYWGQGTLVTVSS |
| DKK1-264 | 559 | EVQLLESGGGLVQPGGSLRLSCAASGFTFKSYGMHWVRQAPGKGLEWVSSIWPRGQKTYYADSVKGRFTISRDNSKNTLYLQMNSLRAEDTAVYYCAKSGTRIKQGFDYWGQGTLVTVSS |
| DKK1-265 | 560 | EVQLLESGGGLVQPGGSLRLSCAASGFTFRRYVMGWVRQAPGKGLEWVAAISGGGADTYYADSVKGRFTISRDNSKNTLYLQMNSLRAEDTAVYYCARLPKRGPRFDYWGQGTLVTVSS |
| DKK1-266 | 561 | EVQLLESGGGLVQPGGSLRLSCAASGFTFVAYNMGWVRQAPGKGLEWVSSISNSGGSTYYADSVKGRFTISRDNSKNTLYLQMNSLRAEDTAVYYCAKNRAKFDYWGQGTLVTVSS |
| DKK1-267 | 562 | EVQLLESGGGLVQPGGSLRLSCAASGFTFRRYVMGWVRQAPGKGLEWVSVISSSGGETSYADSVKGRFTISRDNSKNTLYLQMNSLRAEDTAVYYCAKLPKRGPRFDYWGQGTLVTVSS |
| DKK1-268 | 563 | EVQLLESGGGLVQPGGSLRLSCAASGFTFRRYVMGWVRQAPGKGLEWVSAIEGAGSDTYYADSVKGRFTISRDNSKNTLYLQMNSLRAEDTAVYYCAKFRGRGFDYWGQGTLVTVSS |
| DKK1-269 | 564 | EVQLLESGGGLVQPGGSLRLSCAASGFTFSRYGMHWVRQAPGKGLEWVAVISYGGSNKYYADSVKGRFTISRDNSKNTLYLQMNSLRAEDTAVYYCAKGVRKGFDYWGQGTLVTVSS |
| DKK1-270 | 565 | EVQLLESGGGLVQPGGSLRLSCAASGFTFGNYAMAWVRQAPGKGLEWVSAIQQRGLKTAYADSVKGRFTISRDNSKNTLYLQMNSLRAEDTAVYYCARGYRGYFDYWGQGTLVTVSS |
| DKK1-271 | 566 | EVQLLESGGGLVQPGGSLRLSCAASGYSISSGYHWAWVRQAPGKGLEWVSSIDDRGRYTYYADSVKGRFTISRDNSKNTLYLQMNSLRAEDTAVYYCAKSNGRFDYWGQGTLVTVSS |

TABLE 6-continued

Additional Variable Heavy Chain Domain Sequences

| DKK1 Variant | SEQ ID NO | VH Sequence |
|---|---|---|
| DKK1-272 | 567 | EVQLLESGGGLVQPGGSLRLSCAASGFTFRRYVMGWVRQAPGKGLEWVSAISGSGGGTSYADSVKGRFTISRDNSKNTLYLQMNSLRAEDTAVYYCAKYFHGKFDYWGQGTLVTVSS |
| DKK1-273 | 568 | EVQLLESGGGLVQPGGSLRLSCAASGFTFHKYGMAWVRQAPGKGLEWVSEISPSGKKKYYADSVKGRFTISRDNSKNTLYLQMNSLRAEDTAVYYCAKGRWSIFDYWGQGTLVTVSS |
| DKK1-274 | 569 | EVQLLESGGGLVQPGGSLRLSCAASGFTFRRYVMGWVRQAPGKGLEWVADVNPNSGASIYNDSVKGRFTISRDNSKNTLYLQMNSLRAEDTAVYYCAKGPGTRGDYWGQGTLVTVSS |
| DKK1-275 | 570 | EVQLLESGGGLVQPGGSLRLSCAASGFTFNKYPMMWVRQAPGKGLEWVSGIYPSGGSTVYDDSVKGRFTISRDNSKNTLYLQMNSLRAEDTAVYYCAKWSSRAFDYWGQGTLVTVSS |
| DKK1-276 | 571 | EVQLLESGGGLVQPGGSLRLSCAASGFTFRRYVMGWVRQAPGKGLEWVSAIEGAGSDTYYADSVKGRFTISRDNSKNTLYLQMNSLRAEDTAVYYCARLPKRGPRFDYWGQGTLVTVSS |
| DKK1-277 | 572 | EVQLLESGGGLVQPGGSLRLSCAASGFTFRRYVMGWVRQAPGKGLEWVSAIEGAGSDTYYADSVKGRFTISRDNSKNTLYLQMNSLRAEDTAVYYCARLPKRGPRFDYWGQGTLVTVSS |
| DKK1-278 | 573 | EVQLLESGGGLVQPGGSLRLSCAASGFTFSSYVMIWVRQAPGKGLEWVSEISPSGKKKYYADSVKGRFTISRDNSKNTLYLQMNSLRAEDTAVYYCAKYPKNFDYWGQGTLVTVSS |
| DKK1-279 | 574 | EVQLLESGGGLVQPGGSLRLSCAASGFTFRRYVMGWVRQAPGKGLEWVAAISGGGADTYYADSVKGRFTISRDNSKNTLYLQMNSLRAEDTAVYYCARLPKRGPRFDYWGQGTLVTVSS |
| DKK1-280 | 575 | EVQLLESGGGLVQPGGSLRLSCAASGFTSNNFAMTWVRQAPGKGLEWVGYINPSRGYTYYADSVKGRFTISRDNSKNTLYLQMNSLRAEDTAVYYCAKRTENRGVSFDYWGQGTLVTVSS |
| DKK1-281 | 576 | EVQLLESGGGLVQPGGSLRLSCAASGFTFNKYPMMWVRQAPGKGLEWVSEISPSGKKKYYADSVKGRFTISRDNSKNTLYLQMNSLRAEDTAVYYCAKFRGRGFDYWGQGTLVTVSS |
| DKK1-282 | 577 | EVQLLESGGGLVQPGGSLRLSCAASGFTFFPYAMGWVRQAPGKGLEWVAAISGGGADTYYADSVKGRFTISRDNSKNTLYLQMNSLRAEDTAVYYCARLPKRGPRFDYWGQGTLVTVSS |
| DKK1-283 | 578 | EVQLLESGGGLVQPGGSLRLSCAASGFTFDQYDMSWVRQAPGKGLEWVSAITGSGGSTYYADSVKGRFTISRDNSKNTLYLQMNSLRAEDTAVYYCATAESDDTYDYWGQGTLVTVSS |
| DKK1-284 | 579 | EVQLLESGGGLVQPGGSLRLSCAASGFTFRRYVMGWVRQAPGKGLEWVSAIEGAGSDTYYADSVKGRFTISRDNSKNTLYLQMNSLRAEDTAVYYCARLPKRGPRFDYWGQGTLVTVSS |
| DKK1-285 | 580 | EVQLLESGGGLVQPGGSLRLSCAASGFTFRSYTMVWVRQAPGKGLEWVSAITGTGGETYYADSVKGRFTISRDNSKNTLYLQMNSLRAEDTAVYYCARLPKRGPRFDYWGQGTLVTVSS |
| DKK1-286 | 581 | EVQLLESGGGLVQPGGSLRLSCAASGFTFRRYVMGWVRQAPGKGLEWVSAIEARGGGTYYADSVKGRFTISRDNSKNTLYLQMNSLRAEDTAVYYCAKFRGRGFDYWGQGTLVTVSS |
| DKK1-287 | 582 | EVQLLESGGGLVQPGGSLRLSCAASGFTFGNYAMAWVRQAPGKGLEWVSSIWPSGGQTWYADSVKGRFTISRDNSKNTLYLQMNSLRAEDTAVYYCAKDKRYRGSQHYFDYWGQGTLVTVSS |
| DKK1-288 | 583 | EVQLLESGGGLVQPGGSLRLSCAASGFTFNKYPMMWVRQAPGKGLEWVGISNSGSTSYNDSVKGRFTISRDNSKNTLYLQMNSLRAEDTAVYYCAKRTRSKFDYWGQGTLVTVSS |
| DKK1-289 | 584 | EVQLLESGGGLVQPGGSLRLSCAASGFTFHKYGMAWVRQAPGKGLEWVSSIGRHGGRTYYADSVKGRFTISRDNSKNTLYLQMNSLRAEDTAVYYCAKAGSGFDYWGQGTLVTVSS |
| DKK1-290 | 585 | EVQLLESGGGLVQPGGSLRLSCAASGFTFSSYWNHWVRQAPGKGLEWVSTIGPSGTSTYYADSVKGRFTISRDNSKNTLYLQMNSLRAEDTAVYYCAESFRSRYFDYWGQGTLVTVSS |
| DKK1-291 | 586 | EVQLLESGGGLVQPGGSLRLSCAASGFTFGNYAMAWVRQAPGKGLEWVSSIWPRGQKTYYADSVKGRFTISRDNSKNTLYLQMNSLRAEDTAVYYCASLSRGYWGQGTLVTVSS |
| DKK1-292 | 587 | EVQLLESGGGLVQPGGSLRLSCAASGFTFRSYTMGWVRQAPGKGLEWVAAISGGGADTYYADSVKGRFTISRDNSKNTLYLQMNSLRAEDTAVYYCAKLPKRGPRFDYWGQGTLVTVSS |
| DKK1-293 | 588 | EVQLLESGGGLVQPGGSLRLSCAASGFTFSRYFMGWVRQAPGKGLEWVSAISGRGDNTYYADSVKGRFTISRDNSKNTLYLQMNSLRAEDTAVYYCAKRTENRGVSFDYWGQGTLVTVSS |
| DKK1-294 | 589 | EVQLLESGGGLVQPGGSLRLSCAASGFTFNKYPMMWVRQAPGKGLEWVGAIQQRGLKTAYADSVKGRFTISRDNSKNTLYLQMNSLRAEDTAVYYCARWTSGLDYWGQGTLVTVSS |
| DKK1-295 | 590 | EVQLLESGGGLVQPGGSLRLSCAASGFTFSRYFMGWVRQAPGKGLEWVSEIDALGTDTYYADSVKGRFTISRDNSKNTLYLQMNSLRAEDTAVYYCAKGLRRFDYWGQGTLVTVSS |
| DKK1-296 | 591 | EVQLLESGGGLVQPGGSLRLSCAASGFTFDRYRMMWVRQAPGKGLEWVSSISSTGFKTYYADSVKGRFTISRDNSKNTLYLQMNSLRAEDTAVYYCAKFRGRGFDYWGQGTLVTVSS |

TABLE 6-continued

Additional Variable Heavy Chain Domain Sequences

| DKK1 Variant | SEQ ID NO | VH Sequence |
|---|---|---|
| DKK1-297 | 592 | EVQLLESGGGLVQPGGSLRLSCAASGFTFTHYSMGWVRQAPGKGLEWVSAINGTGGETYYADSVKGRFTISRDNSKNTLYLQMNSLRAEDTAVYYCARLPKRGPRFDYWGQGTLVTVSS |
| DKK1-298 | 593 | EVQLLESGGGLVQPGGSLRLSCAASGFTFSPYLMSWVRQAPGKGLEWVSTIGPSGTSTYYADSVKGRFTISRDNSKNTLYLQMNSLRAEDTAVYYCAKGRRIFDYWGQGTLVTVSS |
| DKK1-299 | 594 | EVQLLESGGGLVQPGGSLRLSCAASGFTFSNYFMIWVRQAPGKGLEWVSSIDDRGRYTYYADSVKGRFTISRDNSKNTLYLQMNSLRAEDTAVYYCARGGDYGSGDYWGQGTLVTVSS |
| DKK1-300 | 595 | EVQLLESGGGLVQPGGSLRLSCAASGFTFRRYVMGWVRQAPGKGLEWVAAISGGGADTYYADSVKGRFTISRDNSKNTLYLQMNSLRAEDTAVYYCARPPKRGPRFDYWGQGTLVTVSS |
| DKK1-301 | 596 | EVQLLESGGGLVQPGGSLRLSCAASGFTFNKYPMMWVRQAPGKGLEWVSVISSSGGETSYADSVKGRFTISRDNSKNTLYLQMNSLRAEDTAVYYCAKRTRSKFDYWGQGTLVTVSS |
| DKK1-302 | 597 | EVQLLESGGGLVQPGGSLRLSCAASGFTFKSYGMHWVRQAPGKGLEWVSSIGRHGGRTYYADSVKGRFTISRDNSKNTLYLQMNSLRAEDTAVYYCARGGDYGSGDYWGQGTLVTVSS |
| DKK1-303 | 598 | EVQLLESGGGLVQPGGSLRLSCAASGFTFNKYPMMWVRQAPGKGLEWVSYIGPSGGKTYYADSVKGRFTISRDNSKNTLYLQMNSLRAEDTAVYYCAKRTRSKFDYWGQGTLVTVSS |
| DKK1-304 | 599 | EVQLLESGGGLVQPGGSLRLSCAASGFTFRRYVMGWVRQAPGKGLEWVAAISGGGADTYYADSVKGRFTISRDNSKNTLYLQMNSLRAEDTAVYYCARPPKRGPRFDYWGQGTLVTVSS |
| DKK1-305 | 600 | EVQLLESGGGLVQPGGSLRLSCAASGFTFEDETMSWVRQAPGKGLEWVSAIISSGGLTYYADSVKGRFTISRDNSKNTLYLQMNSLRAEDTAVYYCAKGFRIFDYWGQGTLVTVSS |
| DKK1-306 | 601 | EVQLLESGGGLVQPGGSLRLSCAASGFTFNKYPMMWVRQAPGKGLEWVSGITRSGSTNYRDSVKGRFTISRDNSKNTLYLQMNSLRAEDTAVYYCAKWSSRAFDYWGQGTLVTVSS |
| DKK1-307 | 602 | EVQLLESGGGLVQPGGSLRLSCAASGFTFRRYVMGWVRQAPGKGLEWVAAISGGGADTYYADSVKGRFTISRDNSKNTLYLQMNSLRAEDTAVYYCAKHSKSSHRQSFDYWGQGTLVTVSS |
| DKK1-308 | 603 | EVQLLESGGGLVQPGGSLRLSCAASGFTFNKYPMMWVRQAPGKGLEWVSEISPSGKKKYYADSVKGRFTISRDNSKNTLYLQMNSLRAEDTAVYYCAKLTGRFDYWGQGTLVTVSS |
| DKK1-309 | 604 | EVQLLESGGGLVQPGGSLRLSCAASGFTFSRYFMGWVRQAPGKGLEWVSEISPSGKKKYYADSVKGRFTISRDNSKNTLYLQMNSLRAEDTAVYYCAKSGAYFDYWGQGTLVTVSS |
| DKK1-310 | 605 | EVQLLESGGGLVQPGGSLRLSCAASGFTFNKYPMMWVRQAPGKGLEWVSWIEGRGTETYYADSVKGRFTISRDNSKNTLYLQMNSLRAEDTAVYYCAKRTRSKFDYWGQGTLVTVSS |
| DKK1-311 | 606 | EVQLLESGGGLVQPGGSLRLSCAASGFTFHKYGMAWVRQAPGKGLEWVSEISPSGKKKYYADSVKGRFTISRDNSKNTLYLQMNSLRAEDTAVYYCAKYPKNFDYWGQGTLVTVSS |
| DKK1-312 | 607 | EVQLLESGGGLVQPGGSLRLSCAASGFTFRRYVMGWVRQAPGKGLEWVSEISPSGKKKYYADSVKGRFTISRDNSKNTLYLQMNSLRAEDTAVYYCAKGVRKKFDYWGQGTLVTVSS |
| DKK1-313 | 608 | EVQLLESGGGLVQPGGSLRLSCAASGFTFRRYVMGWVRQAPGKGLEWVAAISGGGADTYYADSVKGRFTISRDNSKNTLYLQMNSLRAEDTAVYYCARLPKRGPRFDYWGQGTLVTVSS |
| DKK1-314 | 609 | EVQLLESGGGLVQPGGSLRLSCAASGFTFGNYAMAWVRQAPGKGLEWVSYISPIGPRTYYADSVKGRFTISRDNSKNTLYLQMNSLRAEDTAVYYCAKRTENRGVSFDYWGQGTLVTVSS |
| DKK1-315 | 610 | EVQLLESGGGLVQPGGSLRLSCAASGFTLDYLAIGWVRQAPGKGLEWVSEISPSGKKKYYADSVKGRFTISRDNSKNTLYLQMNSLRAEDTAVYYCAKYTGRWEPFDYWGQGTLVTVSS |
| DKK1-316 | 611 | EVQLLESGGGLVQPGGSLRLSCAASGFTFTHYSMGWVRQAPGKGLEWVAAISGGGADTYYADSVKGRFTISRDNSKNTLYLQMNSLRAEDTAVYYCARLPKRGPRFDYWGQGTLVTVSS |
| DKK1-317 | 612 | EVQLLESGGGLVQPGGSLRLSCAASGFTFRRYVMGWVRQAPGKGLEWVSAITGTGGETYYADSVKGRFTISRDNSKNTLYLQMNSLRAEDTAVYYCARLPKRGPRFDYWGQGTLVTVSS |
| DKK1-318 | 613 | EVQLLESGGGLVQPGGSLRLSCAASGFTFRRYVMGWVRQAPGKGLEWVSTISPSGHGTYYADSVKGRFTISRDNSKNTLYLQMNSLRAEDTAVYYCARRTGREYGGGWYFDYWGQGTLVTVSS |
| DKK1-319 | 614 | EVQLLESGGGLVQPGGSLRLSCAASGFTFPVYNMAWVRQAPGKGLEWVSSISESGTTTYYADSVKGRFTISRDNSKNTLYLQMNSLRAEDTAVYYCAKNRAKFDYWGQGTLVTVSS |
| DKK1-320 | 615 | EVQLLESGGGLVQPGGSLRLSCAASGFTFRRYVMGWVRQAPGKGLEWVAAISGGGADTYYADSVKGRFTISRDNSKNTLYLQMNSLRAEDTAVYYCARLPKRGPRFDYWGQGTLVTVSS |

TABLE 6-continued

Additional Variable Heavy Chain Domain Sequences

| DKK1 Variant | SEQ ID NO | VH Sequence |
|---|---|---|
| DKK1-321 | 616 | EVQLLESGGGLVQPGGSLRLSCAASGFSFSAYAMNWVRQAPGKGLEWVSSISTSGGSTYYADSVKGRFTISRDNSKNTLYLQMNSLRAEDTAVYYCARGRAGADYWGQGTLVTVSS |
| DKK1-322 | 617 | EVQLLESGGGLVQPGGSLRLSCAASGFTFSRFAMSWVRQAPGKGLEWVSAISGSGAYTYYADSVKGRFTISRDNSKNTLYLQMNSLRAEDTAVYYCARDIAAASFDYWGQGTLVTVSS |
| DKK1-323 | 618 | EVQLLESGGGLVQPGGSLRLSCAASGFTFTSYAMTWVRQAPGKGLEWVSGVSGSGGTTYYADSVKGRFTISRDNSKNTLYLQMNSLRAEDTAVYYCAISYHFDYYFDYWGQGTLVTVSS |
| DKK1-324 | 619 | EVQLLESGGGLVQPGGSLRLSCAASGFTFSSYAMNWVRQAPGKGLEWVSAISGGGATYYADSVKGRFTISRDNSKNTLYLQMNSLRAEDTAVYYCARECSGGSCSYYYGMDVWGQGTLVTVSS |
| DKK1-325 | 620 | EVQLLESGGGLVQPGGSLRLSCAASGSTFNNYAMSWVRQAPGKGLEWVSAISGSGSTTYYADSVKGRFTISRDNSKNTLYLQMNSLRAEDTAVYYCARLAVSTSDYYYYGMDVWGQGTLVTVSS |
| DKK1-326 | 621 | EVQLLESGGGLVQPGGSLRLSCAASGFTFGRFAMSWVRQAPGKGLEWVSGITGSGTSTYYADSVKGRFTISRDNSKNTLYLQMNSLRAEDTAVYYCARDDRVRFSPVRRWFDPWGQGTLVTVSS |
| DKK1-327 | 622 | EVQLLESGGGLVQPGGSLRLSCAASGFTFSKYAMGWVRQAPGKGLEWVSAISATGGSTYYADSVKGRFTISRDNSKNTLYLQMNSLRAEDTAVYYCARVRSSSWYGDYWGQGTLVTVSS |
| DKK1-328 | 623 | EVQLLESGGGLVQPGGSLRLSCAASGFTFSRYAMTWVRQAPGKGLEWVSTISGSGVTTYYADSVKGRFTISRDNSKNTLYLQMNSLRAEDTAVYYCARKTGGHYPFDYWGQGTLVTVSS |
| DKK1-329 | 624 | EVQLLESGGGLVQPGGSLRLSCAASGFTFSRSAMSWVRQAPGKGLEWVSSISASGANTYYADSVKGRFTISRDNSKNTLYLQMNSLRAEDTAVYYCARDQARYYGMDVRGQGTLVTVSS |
| DKK1-330 | 625 | EVQLLESGGGLVQPGGSLRLSCAASGFTFRNYAMSWVRQAPGKGLEWVSTITSSGGSTYYADSVKGRFTISRDNSKNTLYLQMNSLRAEDTAVYYCASGLRARNGFDIWGQGTLVTVSS |
| DKK1-331 | 626 | EVQLLESGGGLVQPGGSLRLSCAASGFTFSNYAMTWVRQAPGKGLEWVSGISGSGGSTYYADSVKGRFTISRDNSKNTLYLQMNSLRAEDTAVYYCARGAILAYWGQGTLVTVSS |
| DKK1-332 | 627 | EVQLLESGGGLVQPGGSLRLSCAASGFTFSSYAMIWVRQAPGKGLEWVSAVSGTGGTTYYADSVKGRFTISRDNSKNTLYLQMNSLRAEDTAVYYCARDVGFGELHPWGQGTLVTVSS |
| DKK1-333 | 628 | EVQLLESGGGLVQPGGSLRLSCAASGFTFSSYAMHWVRQAPGKGLEWVSGISGSGYSTYYADSVKGRFTISRDNSKNTLYLQMNSLRAEDTAVYYCARGRTGTLYGMDVWGQGTLVTVSS |
| DKK1-334 | 629 | EVQLLESGGGLVQPGGSLRLSCAASGFSFNNYAMSWVRQAPGKGLEWVSAISGGGSNTYYADSVKGRFTISRDNSKNTLYLQMNSLRAEDTAVYYCARVAASGSYYRAFDQWGQGTLVTVSS |
| DKK1-335 | 630 | EVQLLESGGGLVQPGGSLRLSCAASGFTFRRYAMSWVRQAPGKGLEWVSGISSSGGNTYYADSVKGRFTISRDNSKNTLYLQMNSLRAEDTAVYYCARDRGFGWFDPWGQGTLVTVSS |
| DKK1-336 | 631 | EVQLLESGGGLVQPGGSLRLSCAASGFTFRSYGMTWVRQAPGKGLEWVSTISGSGGRTYYADSVKGRFTISRDNSKNTLYLQMNSLRAEDTAVYYCAKVSYDSSGYYYDAFDIWGQGTLVTVSS |
| DKK1-337 | 632 | EVQLLESGGGLVQPGGSLRLSCAASGFTFANYAMSWVRQAPGKGLEWVSAISGSGGSAYYADSVKGRFTISRDNSKNTLYLQMNSLRAEDAAVYYCARSGSFLSFDSWGQGTLVTVSS |
| DKK1-338 | 633 | EVQLLESGGGLVQPGGSLRLSCAASGFTFGRFAISWVRQAPGKGLEWVSTISGSGGRTYYADSVKGRFTISRDNSKNTLYLQMNSLRAEDTAVYYCARVDYKKKSYYNAMDAWGQGTLVTVSS |
| DKK1-339 | 634 | EVQLLESGGGLVQPGGSLRLSCAASGFTFRTSAMSWVRQAPGKGLEWVSAISSGGGGTYYADSVKGRFTISRDNSKNTLYLQMNSLRAEDTAVYYCARGPRGRGAFDVWGQGTLVTVSS |
| DKK1-340 | 635 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDDRVRFSPVRRWFDPWGQGTLVTVSS |
| DKK1-341 | 636 | EVQLLESGGGLVQPGGSLRLSCAASGIHLSSYAMSWVRQAPGKGLEWVSTISGGGGGTYYADSVKGRFTISRDNSKNTLYLQMNSLRAEDTAVYYCARGGHVGIRRPFDVWGQGTLVTVSS |
| DKK1-342 | 637 | EVQLLESGGGLVQPGGSLRLSCAASGFTFSKYAMSWVRQAPGKGLEWVSIISGSGGTTYYADSVKGRFTISRDNSKNTLYLQMNSLRAEDTAVYYCARHAHGAGSYPFDYWGQGTLVTVSS |
| DKK1-343 | 638 | EVQLLESGGGLVQPGGSLRLSCAASGFPFSSYAMGWVRQAPGKGLEWVSVISGSGGRTHYADSVKGRFTISRDNSKNTLYLQMNSLRAEDTAVYYCGRAPRKYYGMDVWGQGTLVTVSS |
| DKK1-344 | 639 | EVQLLESGGGLVQPGGSLRLSCAASGFSFSAYAMSWVRQAPGKGLEWVSAISGRDTSTYYADSVKGRFTISRDNSKNTLYLQMNSLRAEDTAVYYCARVPLRGSGRLSFDYWGQGTLVTVSS |
| DKK1-345 | 640 | EVQLLESGGGLVQPGGSLRLSCAASGSPFSNYAMSWVRQAPGKGLEWVSAISGSGGSTFYSDSVKGRFTISRDNSKNTLYLQMNSLRAEDTAVYYCARAPRSPILGVRRGLDPWGQGTLVTVSS |

TABLE 6-continued

Additional Variable Heavy Chain Domain Sequences

| DKK1 Variant | SEQ ID NO | VH Sequence |
|---|---|---|
| DKK1-346 | 641 | EVQLLESGGGLVQPGGSLRLSCAASGFSFSGYAMNWVRQAPGKGLEWVSAISGSSGRTYYADSVKGRFTISRDNSKNTLYLQMNSLRAEDTAVYYCVRGGTRGLGYWGQGTLVTVSS |
| DKK1-347 | 642 | EVQLLESGGGLVQPGGSLRLSCAASGFTFRTYGMSWVRQAPGKGLEWVSAISGSGETTYYADSVKGRFTISRDNSKNTLYLQMNSLRAEDTAVYYCARLDHDSSGFYEAFDVWGQGTLVTVSS |
| DKK1-348 | 643 | EVQLLESGGGLVQPGGSLRLSCAASGLTFSRYAMSWVRQAPGKGLEWVSSISGRGGNTYYADSVKGRFTISRDNSKNTLYLQMNSLRAEDTAVYYCARGGMRLGKSYYYYGMDVWGQGTLVTVSS |
| DKK1-349 | 644 | EVQLLESGGGLVQPGGSLRLSCAASGFAFSTSAMSWVRQAPGKGLEWVSGISASGGSTHYADSVKGRFTISRDNSKNTLYLQMNSLRAEDTAVYYCARLSVARGAYGMDVWGQGTLVTVSS |
| DKK1-350 | 645 | EVQLLESGGGLVQPGGSLRLSCAASGFTFGAYAMSWVRQAPGKGLEWVSAISGSGARTYYADSVKGRFTISRDNSKNTLYLQMNSLRAEDTAVYYCARRGRPPQYYFDSWGQGTLVTVSS |
| DKK1-351 | 646 | EVQLLESGGGLVQPGGSLRLSCAASGFTFRRYAMSWVRQAPGKGLEWVSTVSGSGGTTYYADSVKGRFTISRDNSKNTLYLQMNSLRAEDTAVYYCARGWEPGIAANWGQGTLVTVSS |
| DKK1-352 | 647 | EVQLLESGGGLVQPGGSLRLSCAASGFTFSKHAMSWVRQAPGKGLEWVSIISGSGDTTYYADSVKGRFTISRDNSKNTLYLQMNSLRAEDTAVYYCARHQYSGSGSFRYWGQGTLVTVSS |
| DKK1-353 | 648 | EVQLLESGGGLVQPGGSLRLSCAASGFTFRRSAMSWVRQAPGKGLEWVSAIGGSGDNTYYADSVKGRFTISRDNSKNTLYLQMNSLRAEDTAVYYCAKHRGSFWFDPWGQGTLVTVSS |
| DKK1-354 | 649 | EVQLLESGGGLVQPGGSLRLSCAASGFSFRSYAMNWVRQAPGKGLEWVSAISGSGGNTFYADSVKGRFTISRDNSKNTLYLQMNSLRAEDTAVYYCTTMFGSGTFYTGFDFWGQGTLVTVSS |
| DKK1-355 | 650 | EVQLLESGGGLVQPGGSLRLSCAASGFTFSSSSMSWIRQAPGKGLEWVSGISGSGGTTYYADSVKGRFTISRDNSKNTLYLQMNSLRAEDTAVYYCARAGARFVGFDYWGQGTLVTVSS |
| DKK1-356 | 651 | EVQLLESGGGLVQPGGSLRLSCAASGFTFSRFAMSWVRQAPGKGLEWVSAISGSGRNTYYADSVKGRFTISRDNSKNTLYLQMNSLRAEDTAVYYCATFNPVGLFYWGQGTLVTVSS |
| DKK1-357 | 652 | EVQLLESGGGLVQPGGSLRLSCAASGFSFSTYAMMWVRQAPGKGLEWVSAISGSAVSTYYADSVKGRFTISRDNSKNTLYLQMNSLRAEDAAVYYCARSGSFLSFDSWGQGTLVTVSS |
| DKK1-358 | 653 | EVQLLESGGGLVQPGGSLRLSCAASGFTFSRYTMNWVRQAPGKGLEWVSAVSGSGGRTYYADSVKGRFTISRDNSKNTLYLQMNSLRAEDTAVYYCARSRNGRWFDPWGQGTLVTVSS |
| DKK1-359 | 654 | EVQLLESGGGLVQPGGSLRLSCAASGLTFRSYAMSWVRQAPGKGLEWVSGISGSGGGSTYYADSVKGRFTISRDNSKNTLYLQMNSLRAEDTAVYYCARGASFDSWGQGTLVTVSS |
| DKK1-360 | 655 | EVQLLESGGGLVQPGGSLRLSCAASGFTFSNYAMKWVRQAPGKGLEWVSGISGSGARTYYADSVKGRFTISRDNSKNTLYLQMNSLRAEDTAVYYCARGRQRQRSTPLGRYWGQGTLVTVSS |
| DKK1-361 | 656 | EVQLLESGGGLVQPGGSLRLSCAASGFNFRDYAMSWVRQAPGKGLEWVSAISGRGSVYYADSVKGRFTISRDNSKNTLYLQMNSLRAEDTAVYYCARGGDWVAFDYWGQGTLVTVSS |
| DKK1-362 | 657 | EVQLLESGGGLVQPGGSLRLSCAASGFTFSGYVMSWFRQAPGKGLEWVSGISGSGGRTYYADSVKGRFTISRDNSKNTLYLQMNSLRAEDTAVYYCARRKGPTYGMDVWGQGTLVTVSS |
| DKK1-363 | 658 | EVQLLESGGGLVQPGGSLRLSCAASGFTFSTFAMAWVRQAPGKGLEWVSALSGSGGRTYYADSVKGRFTISRDNSKNTLYLQMNSLRAEDTAVYYCARVTRYQGWLSHFDYWGQGTLVTVSS |
| DKK1-364 | 659 | EVQLLESGGGLVQPGGSLRLSCAASGFTLSTYAMSWVRQAPGKGLEWVSTISTSGGSTYYADSVKGRFTISRDNSKNTLYLQMNSLRAEDTAVYYCARVFVSSGWYDGMDVWGQGTLVTVSS |
| DKK1-365 | 660 | EVQLLESGGGLVQPGGSLRLSCAASGLTFNNYAMSWVRQAPGKGLEWVSGISGSGARTYYADSVKGRFTISRDNSKNTLYLQMNSLRAEDTAVYYCARGASLDVWGQGTLVTVSS |
| DKK1-366 | 661 | EVQLLESGGGLVQPGGSLRLSCAASGFTFGRYAMSWVRQAPGKGLEWVSTISGSGTTTYYADSVKGRFTISRDNSKNTLYLQMNSLRAEDTAVYYCARAIGGRTAYWGQGTLVTVSS |
| DKK1-367 | 662 | EVQLLESGGGLVQPGGSLRLSCAASGFSFSAYAMSWVRQAPGKGLEWVSAISGRDTSTYYADSVKGRFTISRDNSKNTLYLQMNSLRAEDTAVYYCARVPLRGSGRLSFDYWGQGTLVTVSS |
| DKK1-368 | 663 | EVQLLESGGGLVQPGGSLRLSCAASGFTFGRYAMNWVRQAPGKGLEWVSTITASGGSTYYADSVKGRFTISRDNSKNTLYLQMNSLRAEDTAVYYCARVVTAMGYYYGMDVWGQGTLVTVSS |
| DKK1-369 | 664 | EVQLLESGGGLVQPGGSLRLSCAASGFTFSNYGVSWVRQAPGKGLEWVSAISAGGGNTYYADSVKGRFTISRDNSKNTLYLQMNSLRAEDTAVYYCARDLGMRGPYYYYGMDVWGQGTLVTVSS |

TABLE 6-continued

Additional Variable Heavy Chain Domain Sequences

| DKK1 Variant | SEQ ID NO | VH Sequence |
|---|---|---|
| DKK1-370 | 665 | EVQLLESGGGLVQPGGSLRLSCAASGFTFSYYGMSWVRQAPGKGLEWVSAISGGGAGTYYADSVKGRFTISRDNSKNTLYLQMNSLRAEDTAVYYCVASRNYLLDFWGQGTLVTVSS |
| DKK1-371 | 666 | EVQLLESGGGLVQPGGSLRLSCAASGFTFTKYAMSWVRQAPGKGLEWVGAISGRGGSTYYADSVKGRFTISRDNSKNTLYLQMNSLRAEDTAVYYCARGDLTVTRKYDSWGQGTLVTVSS |
| DKK1-372 | 667 | EVQLLESGGGLVQPGGSLRLSCAASGFTFRSYGMTWVRQAPGKGLEWVSAISRSGGNTYYADSVKGRFTISRDNSKNTLYLQMNSLRAEDTAVYYCARTYSYGSFDYWGQGTLVTVSS |
| DKK1-373 | 668 | EVQLLESGGGLVQPGGSLRLSCAASGFNFRSYAMNWVRQAPGKGLEWVSAISGSGTTTYYADSVKGRFTISRDNSKNTLYLQMNSLRAEDTAVYYCASWRAAPFDYWGQGTLVTVSS |
| DKK1-374 | 669 | EVQLLESGGGLVQPGGSLRLSCAASGFSFSAYAMSWVRQAPGKGLEWVSAISGRDTSTYYADSVKGRFTISRDNSKNTLYLQMNSLRAEDTAVYYCARVPLRGSGRLSFDYWGQGTLVTVSS |
| DKK1-375 | 670 | EVQLLESGGGLVQPGGSLRLSCAASGFTFGNYAMTWVRQAPGKGLEWVSSITGSGGSTYYADSVKGRFTISRDNSKNTLYLQMNSLRAEDTAVYYCAKGKFHLDPWGQGTLVTVSS |
| DKK1-376 | 671 | EVQLLESGGGLVQPGGSLRLSCAASGFSFSSYAMSWVRQAPGKGLEWVGAISGRGGSTYYADSVKGRFTISRDNSKNTLYLQMNSLRAEDTAVYYCTTDYGAIMDVWGQGTLVTVSS |
| DKK1-377 | 672 | EVQLLESGGGLVQPGGSLRLSCAASGFTFGRFAMSWVRQAPGKGLEWVSGISGSGTSTYYADSVKGRFTISRDNSKNTLYLQMNSLRAEDTAVYYCARDSRNYFGMGVWGQGTLVTVSS |
| DKK1-378 | 673 | EVQLLESGGGLVQPGGSLRLSCAASGFTFGNYALSWVRQAPGKGLEWVSAISRSGGNTYYADSVKGRFTISRDNSKNTLYLQMNSLRAEDTAVYYCGRDGTRFGAFDIWGQGTLVTVSS |
| DKK1-379 | 674 | EVQLLESGGGLVQPGGSLRLSCAASGFTFNKFAMTWVRQAPGKGLEWVSTISGSGSRTYYADSVKGRFTISRDNSKNTLYLQMNSLRAEDTAVYYCARGRSWYNHWGQGTLVTVSS |
| DKK1-380 | 675 | EVQLLESGGGLVQHGGSLRLSCAASGLTFSSYALSWVRQAPGKGLEWVSDISGSGGNTYYADSVKGRFTISRDNSKNTLYLQMNSLRAEDTAVYYCARFQPRPLRLFDYWGQGTLVTVSS |
| DKK1-381 | 676 | EVQLLESGGGLVQPGGSLRLSCAASGFTLRSYAMTWVRQAPGKGLEWVSAISGSGGYTYYADSVKGRFTISRDNSKNTLYLQMNSLRAEDTAVYYCARASYGSGSYPLIHWGQGTLVTVSS |
| DKK1-382 | 677 | EVQLLESGGGLVQPGGSLRLSCAASGFTFSSFAMSWVRQAPGKGLEWVSTVSGSGGSTYYADSVKGRFTISRDNSKNTLYLQMNSLRAEDTAVYYCAGHRSNIGWDVWGQGTLVTVSS |
| DKK1-383 | 678 | EVQLLESGGGLVQPGGSLRLSCAASGSTFSSYAMSWVRQAPGKGLEWVSTISASGGRTYYADSVKGRFTISRDNSKNTLYLQMNSLRAEDTAVYYCARDDRVRFSPVRRWFDPWGQGTLVTVSS |
| DKK1-384 | 679 | EVQLLESGGGLVQPGGSLRLSCAASGFTFRRSAMSWVRQAPGKGLEWVSAISGSGSGTYYADSVKGRFTISRDNSKNTLYLQMNSLRAEDTAVYYCARSARGRWFDPWGQGTLVTVSS |
| DKK1-385 | 680 | EVQLLESGGGLVQPGGSLRLSCAASGFTFAGYAMSWVRQALGKGLEWVSAISRSGDRTYYADSVKGRFTISRDNSKNTLYLQMNSLRAEDTAVYYCAKGQRAHQQLVRGAMDVWGQGTLVTVSS |
| DKK1-386 | 681 | EVQLLESGGGLVQPGGSLRLSCAASGFTFRTFAMSWVRQAPGKGLEWVSGISASGGTTYYADSVKGRFTISRDNSKNTLYLQMNSLRAEDTAVYYCAHRRRSKFWSGFGVWGQGTLVTVSS |
| DKK1-387 | 682 | EVQLLESGGGLVQPGGSLRLSCAASGFTFSRYAMTWVRQAPGKGLEWVSTISGSGVTTYYADSVKGRFTISRDNSKNTLYLQMNSLRAEDTAVYYCARKTGGHYPFDYWGQGTLVTVSS |
| DKK1-388 | 683 | EVQLLESGGGLVQPGGSLRLSCAASGFTFDNYAMTWVRQAPGKGLEWVSGISGSGGSIYYADSVKGRFTISRDNSKNTLYLQMNSLRAEDTAVYYCVKGAPAGYLDSWGQGTLVTVSS |
| DKK1-389 | 684 | EVQLLESGGGLVQPGGSLRLSCAASGFRFSSYAMSWVRQAPGKGLEWVSTIGRGGSTDYADSVKGRFTISRDNSKNTLYLQMNSLRAEDTAVYYCARHNRERRAFDIWGQGTLVTVSS |
| DKK1-390 | 685 | EVQLLESGGGLVQPGGSLRLSCAASGFTFRSYAMGWVRQAPGKGLEWVSGISGGGGTTYYADSVKGRFTISRDNSKNTLYLQMNSLRAEDTAVYYCARDSRVRGTHDYYYGMDVWGQGTLVTVSS |
| DKK1-391 | 686 | EVQLLESGGGLVQPGGSLRLSCAASGFTFSKFAMNWVRQAPGKGLEWVSGISASGGRTYYADSVKGRFTISRDNSKNTLYLQMNSLRAEDTAVYYCARGSLRFTPWGQGTLVTVSS |
| DKK1-392 | 687 | EVQLLESGGGLVQPGGSLRLSCAASGFTFSSSGMSWVRQAPGKGLEWVSAISPSGGSTYYADSVKGRFTISRDNSKNTLYLQMNSLRAEDTAVYYCARLSADRVFAFDIWGQGTLVTVSS |
| DKK1-393 | 688 | EVQLLESGGGLVQPGGSLRLSCAASGFSFSSFAMAWVRQAPGKGLEWVSTISGSGDVTYYADSVKGRFTISRDNSKNTLYLQMNSLRAEDTAVYYCAGHRSNIGWDVWGQGTLVTVSS |
| DKK1-394 | 689 | EVQLLESGGGLVQPGGSLRLSCAASGFTFGRFAMSWVRQAPGKGLEWVSGITGSGTSTYYADSVKGRFTISRDNSKNTLYLQMNSLRAEDTAVYYCARVPLRGSGRLSFDYWGQGTLVTVSS |

TABLE 6-continued

Additional Variable Heavy Chain Domain Sequences

| DKK1 Variant | SEQ ID NO | VH Sequence |
|---|---|---|
| DKK1-395 | 690 | EVQLLESGGGLVQPGGSLRLSCAASGFGFSSYAMSWVRQAPGKGLEWVSGITGSGGNTYYADSVKGRFTISRDNSKNTLYLQMNSLRAEDTAVYYCAKSRRPRYSYGFAFESWGQGTLVTVSS |
| DKK1-396 | 691 | EVQLLESGGGLVQPGGSLRLSCAASGVTFRNYAMSWVRQAPGKGLEWVSAISASGGSPYYADSVKGRFTISRDNSKNTLYLQMNSLRAEDTAVYYCARDTSVGWFDPWGQGTLVTVSS |
| DKK1-397 | 692 | EVQLLESGGGLVQPGGSLRLSCAASGFTFRNYAMSWVRQAPGKGLEWVSSISGGGGRTYYADSVKGRFTISRDNSKNTLYLQMNSLRAEDTAVYYCVRDLTRRAAMDVWGQGTLVTVSS |
| DKK1-398 | 693 | EVQLLESGGGLVQPGGSLRLSCAASGFTFRSSAMSWVRQAPGKGLEWVSVISGSGRSTYYADSVKGRFTISRDNSKNTLYLQMNSLRAEDTAVYYCARNGAGSHYYAMDVWGQGTLVTVSS |
| DKK1-399 | 694 | EVQLLESGGGLVQPGGSLRLSCAASGFTFSRFAMGWVRQAPGKGLEWVSSISGSGGRTYYADSVKGRFTISRDNSKNTLYLQMNSLRAEDTAVYYCASSKVTRSALDYWGQGTLVTVSS |
| DKK1-400 | 695 | EVQLLESGGGLVQPGGSLRLSCAASGFTFGNYALSWVRQAPGKGLEWVSAISGSGSSTFYADSVKGRFTISRDNSKNTLYLQMNSLRAEDTAVYYCGRESGRGSGTWGQGTLVTVSS |
| DKK1-401 | 696 | EVQLLESGGGLVQPGGSLRLSCAASGFTYSSYAMTWVRQAPGKGLEWVSVISGSGGSTYHADSVKGRFTISRDNSKNTLYLQMNSLRAEDTAVYYCARERELYYFYYGMDVWGQGTLVTVSS |
| DKK1-402 | 697 | EVQLLESGGGLVQPGGSLRLSCAASGFTFSTYGMGWVRQAPGKGLEWVSTITGSGGSTYYADSVKGRFTISRDNSKNTLYLQMNSLRAEDTAVYYCARHHNRRSSLDYWGQGTLVTVSS |
| DKK1-403 | 698 | EVQLLESGGGLVQPGGSLRLSCAASGFTFSSSGMSWVRQAPGKGLEWVSGISSTGGTTYYADSVKGRFTISRDNSKNTLYLQMNSLRAEDTAVYYCARRGRRQLRYYYGMDVWGQGTLVTVSS |
| DKK1-404 | 699 | EVQLLESGGGLVQPGGSLRLSCAASGFSFSSSAMNWVRQAPGKGLEWVAAISGSGGTTYYADSVKGRFTISRDNSKNTLYLQMNSLRAEDTAVYYCARARRRSFDWWGQGTLVTVSS |
| DKK1-405 | 700 | EVQLLESGGDLVQPGGSLRLSCAASGFTFSRYAMSWVRQAPGKGLEWVSAISGGRVSTYYADSVKGRFTISRDNSKNTLYLQMNSLRAEDTAVYYCARSLRGNAFDIWGQGTLVTVSS |
| DKK1-406 | 701 | EVQLLESGGGLVQPGGSLRLSCAASGFTFSGYAMSWVRQAPGKGLEWVSSIRGSGGSTYYADSVKGRFTISRDNSKNTLYLQMNSLRAEDTAVYYCAKDLQSRGYWGQGTLVTVSS |
| DKK1-407 | 702 | EVQLLESGGGLVQPGGSLRLSCAASGFTFNKFAMSWVRQAPGKGLEWVSGISVSGGNTYYADSVKGRFTISRDNSKNTLYLQMNSLRAEDTAVYYCARHSRLAALLAWGQGTLVTVSS |
| DKK1-408 | 703 | EVQLLESGGGLVQPGGSLRLSCAASGFTFSSHVMGWVRQAPGKGMEWVSGISGSGAGTYYADSVKGRFTISRDNSKNTLYLQMNSLRAEDTAVYYCAVTGTTGWFDPWGQGTLVTVSS |
| DKK1-409 | 704 | EVQLLESGGGLVQPGGSLRLSCAASGFTFGRYAMSWVRQAPGKGLEWVSGISSSRGSTYYADSVKGRFTISRDNSKNTLYLQMNSLRAEDTAVYYCARVGIAGRGMDVWGQGTLVTVSS |
| DKK1-410 | 705 | EVQLLESGGGLVQPGGSLRLSCAASGFTFNTYGMSWVRQAPGKGLEWVSAISGRRTYYADSVKGRFTISRDNSKNTLYLQMNSLRAEDTAVYYCARVSRGYPRRSDSWGQGTLVTVSS |
| DKK1-411 | 706 | EVQLLESGGGLVQPGGSLRLSCAASGFTVSSYAMSWVRQAPGKGLEWVSGISGGGGTTYYADSVKGRFTISRDNSKNTLYLQMNSLRAEDTAVYYCVRSSNWKFDQWGQGTLVTVSS |
| DKK1-412 | 707 | EVQLLESGGGLVQPGGSLRLSCAASGFTFSRSAMSWVRQAPGKGLEWVSSISASGANTYYADSVKGRFTISRDNSKNTLYLQMNSLRAEDTAVYYCARDQARYYGMDVRGQGTLVTVSS |
| DKK1-413 | 708 | EVQLLESGGGLVQPGGSLRLSCAASGFTFRSYDMTWVRQAPGKGLEWVSSISGSGVTTYYADSVKGRFTISRDNSKNTLYLQMNSLRAEDTAVYYCARGRRLDYWGQGTLVTVSS |
| DKK1-414 | 709 | EVQLLESGGGLVQPGGSLRLSCAASGFAFTTYAMGWVRQAPGKGLEWVSAISGSGSTTYYADSVKSRFTISRDNSKNTLYLQMNSLRAEDTAVYYCARSGSFLSFDSWGQGTLVTVSS |
| DKK1-415 | 710 | EVQLLESGGGLVQPGGSLRLSCAASGFTFSSYDMIWVRQAPRKGLEWVSAISGSGRNTYYADSVKGRFTISRDNSKNTLYLQMNSLRAEDTTVYYCARGGGASNWFDPWGQGTLVTISS |
| DKK1-416 | 711 | EVQLLESGGGLVQPGGSLRLSCAASGFSFSAYAMSWVRQAPGKGLEWVSAISGRDTSTYYADSVKGRFTISRDNSKNTLYLQMNSLRAEDTAVYYCARVPLRGSGRLSFDYWGQGTLVTVSS |
| DKK1-417 | 712 | EVQLLESGGGLVQPGGSLRLSCAASGFTFSRFAMSWVRQAPGKGLEWVSSISGTGSSTYYADSVKGRFTISRDNSKNTLYLQMNSLRAEDTAVYYCARVPGNWGQGTLVTVSS |
| DKK1-418 | 2164 | EVQLVESGGGLVQPGGSLRLSCAASGIPFSSRTMGWFRQAPGKEREFVAAISRSGTGTYYADSVKGRFTISADNSKNTAYLQMNSLKPEDTAVYYCAAGNGGRTYGHSRARYDWGQGTLVTVSS |

TABLE 6-continued

Additional Variable Heavy Chain Domain Sequences

| DKK1 Variant | SEQ ID NO | VH Sequence |
|---|---|---|
| DKK1-419 | 2165 | EVQLVESGGGLVQPGGSLRLSCAASGGIYRVNTMGWFRQAPGKEREFVAAINWSGGSTIYADSVKGRFTISADNSKNTAYLQMNSLKPEDTAVYYCAAGNGGRKYGHHRARYDWGQGTLVTVSS |
| DKK1-420 | 2166 | EVQLVESGGGLVQPGGSLRLSCAASGFLMYDRAMGWFRQAPGKEREIVAAISRTGSSIYYADSVKGRFTISADNSKNTAYLQMNSLKPEDTAVYYCAAGNGGRKYGHHRARYDWGQGTLVTVSS |
| DKK1-421 | 2167 | EVQLVESGGGLVQPGGSLRLSCAASGRTFSRFAMGWFRQAPGKERELVAAISARGMPAYADSVKGRFTISADNSKNTAYLQMNSLKPEDTAVYYCAAGNGGRTYGHSRARYEWGQGTLVTVSS |
| DKK1-422 | 2168 | EVQLVESGGGLVQPGGSLRLSCAASGTTFRINVMGWFRQAPGKEREFVAVVNWNGGSTIYADSVKGRFTISADNSKNTAYLQMNSLKPEDTAVYYCAAGNGGRQYGHSRARYDWGQGTLVTVSS |
| DKK1-423 | 2169 | EVQLVESGGGLVQPGGSLRLSCAASGRTFSNNVMGWFRQAPGKEREMVAAMLSGGSTNYADSVKGRFTISADNSKNTAYLQMNSLKPEDTAVYYCAAGNGGRNYGHSRARYDWGQGTLVTVSS |
| DKK1-424 | 2170 | EVQLVESGGGLVQPGGSLRLSCAASGRTFSDIAMGWFRQAPGKEREFVAAINWSGARTYYADSVKGRFTISADNSKNTAYLQMNSLKPEDTAVYYCAAAPRPKRVSVQYFSTSSNYDWGQGTLVTVSS |
| DKK1-425 | 2171 | EVQLVESGGGLVQPGGSLRLSCAASGHTYNTYPMGWFRQAPGKERELVAVILRGGSTVYADSVKGRFTISADNSKNTAYLQMNSLKPEDTAVYYCAAGNGGRHYGHSRARYDWGQGTLVTVSS |
| DKK1-426 | 2172 | EVQLVESGGGLVQPGGSLRLSCAASGRSLYDRAMGWFRQAPGKEREIVAAISRTGSSIYYADSVKGRFTISADNSKNTAYLQMNSLKPEDTAVYYCAAGNGGRSYGHSRARYDWGQGTLVTVSS |
| DKK1-427 | 2173 | EVQLVESGGGLVQPGGSLRLSCAASGRTFNNYAMGWFRQAPGKERELVAAISWSTGSTYYADSVKGRFTISADNSKNTAYLQMNSLKPEDTAVYYCAAEGGYSGTYYYTGDFDWGQGTLVTVSS |
| DKK1-428 | 2174 | EVQLVESGGGLVQPGGSLRLSCAASGRTLYSYPMGWFRQAPGKEREFVAAISWSAGSTYYADSVKGRFTISADNSKNTAYLQMNSLKPEDTAVYYCAAGNGGSKYGHSRARYDWGQGTLVTVSS |
| DKK1-429 | 2175 | EVQLVESGGGLVQPGGSLRLSCAASGTFRDYAMGWFRQAPGKERELVAAIYGTGGELVYYADSVKGRFTISADNSKNTAYLQMNSLKPEDTAVYYCAAGNGGRQYGHSRARYDWGQGTLVTVSS |
| DKK1-430 | 2176 | EVQLVESGGGLVQPGGSLRLSCAASGGGTFGSYAMGWFRQAPGKEREFVSAITWNGTRTYYADSVKGRFTISADNSKNTAYLQMNSLKPEDTAVYYCAAAPRPKRVSVSYFSTASNYDWGQGTLVTVSS |
| DKK1-431 | 2177 | EVQLVESGGGLVQPGGSLRLSCAASGRTFSNYPMGWFRQAPGKEREFVAATSWSGGSKYYADSVKGRFTISADNSKNTAYLQMNSLKPEDTAVYYCAAGNGGRTYGHSRARYDWGQGTLVTVSS |
| DKK1-432 | 2178 | EVQLVESGGGLVQPGGSLRLSCAASGRTFTNYAMGWFRQAPGKEREFVATISRGGSATYYADSVKGRFTISADNSKNTAYLQMNSLKPEDTAVYYCAAGNGGRHYGHSRARYDWGQGTLVTVSS |
| DKK1-433 | 2179 | EVQLVESGGGLVQPGGSLRLSCAASGRTFSTHAMGWFRQAPGKEREFVAHITRLGVTYYADSVKGRFTISADNSKNTAYLQMNSLKPEDTAVYYCAAGNGGRAYGYSRARYEWGQGTLVTVSS |
| DKK1-434 | 2180 | EVQLVESGGGLVQPGGSLRLSCAASGRSFSMYAMGWFRQAPGKEREFVAAISRDGAATYYADSVKGRFTISADNSKNTAYLQMNSLKPEDTAVYYCAAGNGGRLYGHSRARYDWGQGTLVTVSS |
| DKK1-435 | 2181 | EVQLVESGGGLVQPGGSLRLSCAASGLTFRNYAMGWFRQAPGKEREFVAAVSWSLSRTHYADSVKGRFTISADNSKNTAYLQMNSLKPEDTAVYYCAAAPRPKRASVQYFSTSSNYDWGQGTLVTVSS |
| DKK1-436 | 2182 | EVQLVESGGGLVQPGGSLRLSCAASGFTFDDRAMGWFRQAPGKERELVAAIRWSGGITWYADSVKGRFTISADNSKNTAYLQMNSLKPEDTAVYYCAAGNGGRSYGHSRARYDWGQGTLVTVSS |
| DKK1-437 | 2183 | EVQLVESGGGLVQPGGSLRLSCAASGRTFSSVMGWFRQAPGKEREFVAAINWSGASTVYADSVKGRFTISADNSKNTAYLQMNSLKPEDTAVYYCAAGNGGRYYNHSRTRYEWGQGTLVTVSS |
| DKK1-438 | 2184 | EVQLVESGGGLVQPGGSLRLSCAASGHTFNTYPMGWFRQAPGKEREFVAAINSGGSYTYYADSVKGRFTISADNSKNTAYLQMNSLKPEDTAVYYCAAGNGGRNYGHSRARYEWGQGTLVTVSS |
| DKK1-439 | 2185 | EVQLVESGGGLVQPGGSLRLSCAASGRIFTMGWFRQAPGKEREFVAAISGSGVYTYYADSVKGRFTISADNSKNTAYLQMNSLKPEDTAVYYCAAGNGGRYYGHSRARYDWGQGTLVTVSS |
| DKK1-440 | 2186 | EVQLVESGGGLVQPGGSLRLSCAASGRSFSEYAMGWFRQAPGKEREFLAAISRDGAATYYADSVKGRFTISADNSKNTAYLQMNSLKPEDTAVYYCAAGNGGRKYGHHRARYDWGQGTLVTVSS |
| DKK1-441 | 2187 | EVQLVESGGGLVQPGGSLRLSCAASGFNSGSYTMGWFRQAPGKEREFVAAISWSLSRTFYADSVKGRFTISADNSKNTAYLQMNSLKPEDTAVYYCAAAPRPKRVSVSYFSTASNYDWGQGTLVTVSS |
| DKK1-442 | 2188 | EVQLVESGGGLVQPGGSLRLSCAASGGTAYAMGWFRQAPGKEREFVAAISWSLTRTHYADSVKGRFTISADNSKNTAYLQMNSLKPEDTAVYYCAAAPRPKRVSVRYFSTSSNYDWGQGTLVTVSS |
| DKK1-443 | 2189 | EVQLVESGGGLVQPGGSLRLSCAASGRTFTSYPMGWFRQAPGKEREFVAAISGSGDDTYYADSVKGRFTISADNSKNTAYLQMNSLKPEDTAVYYCAAGNGGRQYGHSRARYDWGQGTLVTVSS |

TABLE 6-continued

Additional Variable Heavy Chain Domain Sequences

| DKK1 Variant | SEQ ID NO | VH Sequence |
|---|---|---|
| DKK1-444 | 2190 | EVQLVESGGGLVQPGGSLRLSCAASGSTFRINVMGWFRQAPGKEREFVAAISASGSALYADSVKGRFTISADNSKNTAYLQMNSLKPEDTAVYYCAAGNGGRTYGHSRARYEWGQGTLVTVSS |
| DKK1-445 | 2191 | EVQLVESGGGLVQPGGSLRLSCAASGGTLNNNPMAMGWFRQAPGKEREFVASINWSGARAYYADSVKGRFTISADNSKNTAYLQMNSLKPEDTAVYYCAAAPRPKRISVQYFTTSSNYDWGQGTLVTVSS |
| DKK1-446 | 2192 | EVQLVESGGGLVQPGGSLRLSCAASGRTFSTYPMGWFRQAPGKEREFVAGIGTRGAPVYADSVKGRFTISADNSKNTAYLQMNSLKPEDTAVYYCAAGNGGRQYGHSRARYDWGQGTLVTVSS |
| DKK1-447 | 2193 | EVQLVESGGGLVQPGGSLRLSCAASGRTFNSYPMGWFRQAPGKEREFVAHITRLGVTYYADSVKGRFTISADNSKNTAYLQMNSLKPEDTAVYYCAAGNGGRYYGHSRARYDWGQGTLVTVSS |
| DKK1-448 | 2194 | EVQLVESGGGLVQPGGSLRLSCAASGIPFSSRTMGWFRQAPGKEREFVAAVGWYGSTYYADSVKGRFTISADNSKNTAYLQMNSLKPEDTAVYYCAAGNGGRQYGHSRARYDWGQGTLVTVSS |
| DKK1-449 | 2195 | EVQLVESGGGLVQPGGSLRLSCAASGIDVNRNAMGWFRQAPGKERELVAAISWSGGRTYYADSVKGRFTISADNSKNTAYLQMNSLKPEDTAVYYCAAAPRPKRVSVHYFSTSSNYDWGQGTLVTVSS |
| DKK1-450 | 2196 | EVQLVESGGGLVQPGGSLRLSCAASGINFSRYGMGWFRQAPGKEREFVAAIDWSGSRSYYADSVKGRFTISADNSKNTAYLQMNSLKPEDTAVYYCAAAPRPKRVSVSYFSTASNYDWGQGTLVTVSS |
| DKK1-451 | 2197 | EVQLVESGGGLVQPGGSLRLSCAASGGTLRGYGMGWFRQAPGKEREFVAAIDWSGSRSYYADSVKGRFTISADNSKNTAYLQMNSLKPEDTAVYYCAAAPRPKYVSVRYFSTSSNYDWGQGTLVTVSS |
| DKK1-452 | 2198 | EVQLVESGGGLVQPGGSLRLSCAASGQTFNMGWFRQAPGKEREFVAAVNWNGDSTYYADSVKGRFTISADNSKNTAYLQMNSLKPEDTAVYYCAAGNGGRKYGHHRARYDWGQGTLVTVSS |
| DKK1-453 | 2199 | EVQLVESGGGLVQPGGSLRLSCAASGYTFRAYVMGWFRQAPGKEREWVARITSGGSTIYADSVKGRFTISADNSKNTAYLQMNSLKPEDTAVYYCAAGNGGRTYGHSRARYEWGQGTLVTVSS |
| DKK1-454 | 2200 | EVQLVESGGGLVQPGGSLRLSCAASGNIFTLNVMGWFRQAPGKEREFVAAINSGGSYTYYADSVKGRFTISADNSKNTAYLQMNSLKPEDTAVYYCAAGNGGRKYGHHRARYDWGQGTLVTVSS |
| DKK1-455 | 2201 | EVQLVESGGGLVQPGGSLRLSCAASGFRMYDRAMGWFRQAPGKEREFVAAISGRSGNTYYADSVKGRFTISADNSKNTAYLQMNSLKPEDTAVYYCAAGNGGRNYGHSRARYDWGQGTLVTVSS |
| DKK1-456 | 2202 | EVQLVESGGGLVQPGGSLRLSCAASGFTFSMWPMGWFRQAPGKEREFVAAISRSGGSTIYADSVKGRFTISADNSKNTAYLQMNSLKPEDTAVYYCAAGNGGRYYNHSRTRYEWGQGTLVTVSS |
| DKK1-457 | 2203 | EVQLVESGGGLVQPGGSLRLSCAASGFTFRSYPMGWFRQAPGKEREFVALIHTGGGTYYADSVKGRFTISADNSKNTAYLQMNSLKPEDTAVYYCAAGNGGRNYGHSRARYDWGQGTLVTVSS |
| DKK1-458 | 2204 | EVQLVESGGGLVQPGGSLRLSCAASGLPFSTKSMGWFRQAPGKERELVAFSSSGGRTIYADSVKGRFTISADNSKNTAYLQMNSLKPEDTAVYYCAAGNGGRHYGHSRARYDWGQGTLVTVSS |
| DKK1-459 | 2205 | EVQLVESGGGLVQPGGSLRLSCAASGNIFRINAMGWFRQAPGKEREWVARINSGGSSTYYADSVKGRFTISADNSKNTAYLQMNSLKPEDTAVYYCAAGNGGRAYGYSRARYEWGQGTLVTVSS |
| DKK1-460 | 2206 | EVQLVESGGGLVQPGGSLRLSCAASGGTFGHYAMGWFRQAPGKEREFVAVISWSLTRTHYADSVKGRFTISADNSKNTAYLQMNSLKPEDTAVYYCAAAPRPKRVSFSYFSTSSNYEWGQGTLVTVSS |
| DKK1-461 | 2207 | EVQLVESGGGLVQPGGSLRLSCAASGRTFNSYPMGWFRQAPGKEREFVAAITWGGSTTLYADSVKGRFTISADNSKNTAYLQMNSLKPEDTAVYYCAAGNGGRSYGHSRARYDWGQGNLVTVSS |
| DKK1-462 | 2208 | EVQLVESGGGLVQPGGSLRLSCAASGITFRRYPMGWFRQAPGKEREFVAGVNWGGGSTKYADSVKGRFTISADNSKNTAYLQMNSLKPEDTAVYYCAAGNGGRAYGYSRARYEWGQGTLVTVSS |
| DKK1-463 | 2209 | EVQLVESGGGLVQPGGSLRLSCAASGRTFSYNPMGWFRQAPGKEREMVATISIGGRTSYADSVKGRFTISADNSKNTAYLQMNSLKPEDTAVYYCAAGNGGRSYGHSRARYDWGQGTLVTVSS |
| DKK1-464 | 2210 | EVQLVESGGGLVQPGGSLRLSCAASGRTFSSLPMGWFRQAPGKEREFVAAIRSSGGLFYADSVKGRFTISADNSKNTAYLQMNSLKPEDTAVYYCAAGNGGRTYGHSRARYEWGQGTLVTVSS |
| DKK1-465 | 2211 | EVQLVESGGGLVQPGGSLRLSCAASGPTFSTNTMGWFRQAPGKEREFVAAIYSGVRSGVSAIYADSVKGRFTISADNSKNTAYLQMNSLKPEDTAVYYCAAGNGGRHYGHSRARYDWGQGTLVTVSS |
| DKK1-466 | 2212 | EVQLVESGGGLVQPGGSLRLSCAASGRTFSNYPMGWFRQAPGKEREFVAAIYGTGGELVYYADSVKGRFTISADNSKNTAYLQMNSLKPEDTAVYYCAAGNGGRKYGHHRARYDWGQGTLVTVSS |
| DKK1-467 | 2213 | EVQLVESGGGLVQPGGSLRLSCAASGRAIGSYAMGWFRQAPGKEREFVATITFSGARTHYADSVKGRFTISADNSKNTAYLQMNSLKPEDTAVYYCAAAPRPKRASVQYFSTSSNYDWGQGTLVTVSS |

TABLE 6-continued

Additional Variable Heavy Chain Domain Sequences

| DKK1 Variant | SEQ ID NO | VH Sequence |
|---|---|---|
| DKK1-468 | 2214 | EVQLVESGGGLVQPGGSLRLSCAASGRTLSRNTMGWFRQAPGKEREFVATIRSGAPVYADSVKGRFTISADNSKNTAYLQMNSLKPEDTAVYYCAAGNGGRHYGHSRARYDWGQGTLVTVSS |
| DKK1-469 | 2215 | EVQLVESGGGLVQPGGSLRLSCAASGRTFIGYHMGWFRQAPGKERELVAIKFSGGTTNYADSVKGRFTISADNSKNTAYLQMNSLKPEDTAVYYCAAGNGGRYYGHSRARYDWGQGTLVTVSS |
| DKK1-470 | 2216 | EVQLVESGGGLVQPGGSLRLSCAASGRTISNYAMGWFRQAPGKEREFVAAISWRGGSTYYADSVKGRFTISADNSKNTAYLQMNSLKPEDTAVYYCAAAPRPKYVSVSYFSTSSNYDWGQGTLVTVSS |
| DKK1-471 | 2217 | EVQLVESGGGLVQPGGSLRLSCAASGRTISNYAMGWFRQAPGKEREFVAAISWALSRTHYADSVKGRFTISADNSKNTAYLQMNSLKPEDTAVYYCAAAPRPKRVSFSYFSTSSNYEWGQGTLVTVSS |
| DKK1-472 | 2218 | EVQLVESGGGLVQPGGSLRLSCAASGTFTSYPMGWFRQAPGKEREFVAAISWTGGSTVYADSVKGRFTISADNSKNTAYLQMNSLKPEDTAVYYCAAGNGGRYYNHSRTRYEWGQGTLVTVSS |
| DKK1-473 | 2219 | EVQLVESGGGLVQPGGSLRLSCAASGRSFSMYAMGWFRQAPGKERELVAAISWSGGSTVYADSVKGRFTISADNSKNTAYLQMNSLKPEDTAVYYCAAEGGYSGTYYYTGDFDWGQGTLVTVSS |
| DKK1-474 | 2220 | EVQLVESGGGLVQPGGSLRLSCAASGLTFRNYAMGWFRQAPGKEREFVAAINWSGARTYYADSVKGRFTISADNSKNTAYLQMNSLKPEDTAVYYCAAAPRPKSISVRYFSTSSNYEWGQGTLVTVSS |
| DKK1-475 | 2221 | EVQLVESGGGLVQPGGSLRLSCAASGFTFSSYAMGWFRQAPGKEREWVSAISADGSDKRYADSVKGRFTISADNSKNTAYLQMNSLKPEDTAVYYCAAGKRYGYYDWGQGTLVTVSS |
| DKK1-476 | 2222 | EVQLVESGGGLVQPGGSLRLSCAASGRTHSIYPMGWFRQAPGKEREFVATIRWGTTDTYYADSVKGRFTISADNSKNTAYLQMNSLKPEDTAVYYCAAAPRPTRVSVRYFSTRSNYNWGQGTLVTVSS |
| DKK1-477 | 2223 | EVQLVESGGGLVQPGGSLRLSCAASGFSLDYVGMGWFRQAPGKEREGVSTIKPSGDTTNYADSVKGRFTISADNSKNTAYLQMNSLKPEDTAVYYCAKYLSFYSDYEVYDWGQGTLVTVSS |
| DKK1-478 | 2224 | EVQLVESGGGLVQPGGSLRLSCAASGSIFRVNVMGWFRQAPGKEREFVGAISMSGANTYYADSVKGRFTISADNSKNTAYLQMNSLKPEDTAVYYCAAGNGGRQYGHSRARYDWGQGTLVTVSS |
| DKK1-479 | 2225 | EVQLVESGGGLVQPGGSLRLSCAASGRTFSSLPMGWFRQAPGKERELVAALNWSGGNTYYADSVKGRFTISADNSKNTAYLQMNSLKPEDTAVYYCAAGNGGRKYGHHRARYDWGQGTLVTVSS |
| DKK1-480 | 2226 | EVQLVESGGGLVQPGGSLRLSCAASGFLMYDRAMGWFRQAPGKEREIVAAISRTGSSIYYADSVKGRFTISADNSKNTAYLQMNSLKPEDTAVYYCAAGNGGRAYGYSRARYEWGQGTLVTVSS |
| DKK1-481 | 2227 | EVQLVESGGGLVQPGGSLRLSCAASGDISSYVMGWFRQAPGKEREFVARITWNGGTHTYYADSVKGRFTISADNSKNTAYLQMNSLKPEDTAVYYCAAGNGGRKYGHHRARYDWGQGTLVTVSS |
| DKK1-482 | 2228 | EVQLVESGGGLVQPGGSLRLSCAASGRTHSIYPMGWFRQAPGKERELVAAVNWNGDSTYYADSVKGRFTISADNSKNTAYLQMNSLKPEDTAVYYCAAGNGGRTYGHSRARYEWGQGTLVTVSS |
| DKK1-483 | 2229 | EVQLVESGGGLVQPGGSLRLSCAASGIPFSSRTMGWFRQAPGKEREFVAAISRSGTGTYYADSVKGRFTISADNSKNTAYLQMNSLKPEDTAVYYCAAGNGGRAYGYSRARYEWGQGTLVTVSS |
| DKK1-484 | 2230 | EVQLVESGGGLVQPGGSLRLSCAASGRTFSNYPMGWFRQAPGKERELVAIIVNGGSTYADSVKGRFTISADNSKNTAYLQMNSLKPEDTAVYYCAAGNGGRAYGYSRARYEWGQGTLVTVSS |
| DKK1-485 | 2231 | EVQLVESGGGLVQPGGSLRLSCAASGMTTIGPMGWFRQAPGKEREFVAAISWDGGNTYYADSVKGRFTISADNSKNTAYLQMNSLKPEDTAVYYCAAGNGGRQYGHSRARYDWGQGTLVTVSS |
| DKK1-486 | 2232 | EVQLVESGGGLVQPGGSLRLSCAASGRASGDYAMGWFRQAPGKEREFVAAISWRGGNTYYADSVKGRFTISADNSKNTAYLQMNSLKPEDTAVYYCAAAPRPKRVSFSYFSTSSNYEWGQGTLVTVSS |
| DKK1-487 | 2233 | EVQLVESGGGLVQPGGSLRLSCAASGRTFSSYPMGWFRQAPGKEREWVAHLLSGGSTVYADSVKGRFTISADNSKNTAYLQMNSLKPEDTAVYYCAAGNGGRAYGYSRARYEWGQGTLVTVSS |
| DKK1-488 | 2234 | EVQLVESGGGLVQPGGSLRLSCAASGRTFSEVVMGWFRQAPGKERELVAVAHWSGGSTFYADSVKGRFTISADNSKNTAYLQMNSLKPEDTAVYYCAAGNGGRSYGHSRARYDWGQGTLVTVSS |
| DKK1-489 | 2235 | EVQLVESGGGLVQPGGSLRLSCAASGSTFSINRMGWFRQAPGKEREFVARITPRGLTEYADSVKGRFTISADNSKNTTYLQMNSLKPEDTAVYYCAAGNGGRAYGYSRARYEWGQGTLVTVSS |
| DKK1-490 | 2236 | EVQLVESGGGLVQPGGSLRLSCAASGRTFSFGWFRQAPGKEREFVAAVIWRGGSTYYADSVKGRFTISADNSKNTAYLQMNSLKPEDTAVYYCAAGNGGRQYGHSRARYDWGQGTLVTVSS |
| DKK1-491 | 2237 | EVQLVESGGGLVQPGGSLRLSCAASGGTFSSYPMGWFRQAPGKEREFVAAISWSGSATFYADSVKGRFTISADNSKNTAYLQMNSLKPEDTAVYYCAAGNGGRSYGHSRARYDWGQGTLVTVSS |
| DKK1-492 | 2238 | EVQLVESGGGLVQPGGSLRLSCAASGRTFSNFAMGWFRQAPGKEREFVAVILRGGSTYADSVKGRFTISADNSKNTAYLQMNSLKPEDTAVYYCAAAPRPKRVSVSYFSTASNYDWGQGTLVTVSS |

TABLE 6-continued

Additional Variable Heavy Chain Domain Sequences

| DKK1 Variant | SEQ ID NO | VH Sequence |
|---|---|---|
| DKK1-493 | 2239 | EVQLVESGGGLVQPGGSLRLSCAASGGTFSRYAMGWFRQAPGKEREFVAAISWSLTRTHYADSVKGRFTISADNSKNTAYLQMNSLKPEDTAVYYCAAAPRPKRVSVQYFVTSSNYDWGQGTLVTVSS |
| DKK1-494 | 2240 | EVQLVESGGGLVQPGGSLRLSCAASGRTLSRSNMGWFRQAPGKEREHVALIRIKDGSIYYADSVKGRFTISADNSKNTAYLQMNSLKPEDTAVYYCAAGNGGRQYGHSRARYDWGQGTLVTVSS |
| DKK1-495 | 2241 | EVQLVESGGGLVQPGGSLRLSCAASGRTFSSGTMGWFRQAPGKERELVAAISRSGTLKAYADSVKGRFTISADNSKNTAYLQMNSLKPEDTAVYYCAAAPRPKRVSVQYFSTSSNYDWGQGTLVTVSS |
| DKK1-496 | 2242 | EVQLVESGGGLVQPGGSLRLSCAASGRTFNSYPMGWFRQAPGKEREFVAAINVGGGTYYADSVKGRFTISADNSKNTAYLQMNSLKPEDTAVYYCAAGNGGRTYGHSRARYDWGQGTLVTVSS |
| DKK1-497 | 2243 | EVQLVESGGGLVQPGGSLRLSCAASGYTLKNYYAMGWFRRAPGKEREFVAAISRSGGTTFYADSVKGRFTISADNSKNTAYLQMNSLKPEDTAVYYCAAAPRPKRASVQYFSTSSNYDWGQGTLVTVSS |
| DKK1-498 | 2244 | EVQLVESGGGLVQPGGSLRLSCAASGHTFNTYPMGWFRQAPGKEREFVAAVSYSGSYYADSVKGRFTISADNSKNTAYLQMNSLKPEDTAVYYCAAGNGGRAYGYSRARYEWGQGTLVTVSS |
| DKK1-499 | 2245 | EVQLVESGGGLVQPGGSLRLSCAASGFTFDDRAMGWFRQAPGKEREFVASISTSGTRTLYADSVKGRFTISADNSKNTAYLQMNSLKPEDTAVYYCAAGNGGRQYGHSRARYDWGQGTLVTVSS |
| DKK1-500 | 2246 | EVQLVESGGGLVQPGGSLRLSCAASGRTLSSYAMGWFRQAPGKEREWVATIGTSGPPRYADSVKGRFTISADNSKNTAYLQMNSLKPEDTAVYYCAAGNGGRTYGHSRARYEWGQGTLVTVSS |
| DKK1-501 | 2247 | EVQLVESGGGLVQPGGSLRLSCAASGRIFTNTAMGWFRQAPGKEREFVAAISWGGGLTVYADSVKGRFTISADNSKNTAYLQMNSLKPEDTAVYYCAAGNGGSRYGHSRARYDWGQGTLVTVSS |
| DKK1-502 | 2248 | EVQLVESGGGLVQPGGSLRLSCAASGRIFTMGWFRQAPGKEREFVAAISWTAGTTYYADSVKGRFTISADNSKNTAYLQMNSLKPEDTAVYYCAAGNGGRNYGHSRARYDWGQGTLVTVSS |
| DKK1-503 | 2249 | EVQLVESGGGLVQPGGSLRLSCAASGNIFTRHIMGWFRQAPGKEREWVARINTGGGSTFYADSVKGRFTISADNSKNTAYLQMNSLKPEDTAVYYCAAGNGGRTYGHSRARYEWGQGTLVTVSS |
| DKK1-504 | 2250 | EVQLVESGGGLVQPGGSLRLSCAASGRTFSNYPMGWFRQAPGKEREFVAAISWSSGNAYYADSVKGRFTISADNSKNTAYLQMNSLKPEDTAVYYCAVGNGGRQYGHSRARYDWGQGTLVTVSS |
| DKK1-505 | 2251 | EVQLVESGGGLVQPGGSLRLSCAASGRTFTSYPMGWFRQAPGKEREWVATIGTHGTPLYADSVKGRFTISADNSKNTAYLQMNSLKPEDTAVYYCAAGNGGRQYGHSRARYDWGQGTLVTVSS |
| DKK1-506 | 2252 | EVQLVESGGGLVQPGGSLRLSCAASGQTFNGWFRQAPGKEREFVATISRSGVLYADSVKGRFTISADNSKNTAYLQMNSLKPEDTAVYYCAAGNGGRAYGYSRARYEWGQGTLVTVSS |
| DKK1-507 | 2253 | EVQLVESGGGLVQPGGSLRLSCAASGRSFSEYPMGWFRQAPGKEREFVAAITWSGDMSVYADSVKGRFTISADNSKNTAYLQMNSLKPEDTAVYYCAAGNGGRHYGHSRARYDWGQGTLVTVSS |
| DKK1-508 | 2254 | EVQLVESGGGLVQPGGSLRLSCAASGRSFSSYPMGWFRQAPGKEREFVATINTAGWTTYADSVKGRFTISADNSKNTAYLQMNSLKPEDTAVYYCAAGNGGRSYGHSRARYDWGQGTLVTVSS |
| DKK1-509 | 2255 | EVQLVESGGGLVQPGGSLRLSCAASGLTFRNYAMGWFRQAPGKEREFVAAISWSGGKLYYADSVKGRFTISADNSKNTAYLQMNSLKPEDTAVYYCAAAPRPKRISVSYFSTTSNYDWGQGTLVTVSS |
| DKK1-510 | 2256 | EVQLVESGGGLVQPGGSLRLSCAASGSTFSSYPMGWFRQAPGKERELVALIHTGGTYYADSVKGRFTISADNSKNTAYLQMNSLKPEDTAVYYCAAGNGGRQYGHSRARYDWGQGTLVTVSS |
| DKK1-511 | 2257 | EVQLVESGGGLVQPGGSLRLSCAASGIDVNRNAMGWFRQAPGKEREFVGAVSWSGGTTVYADSVKGRFTISADNSKNTAYLQMNSLKPEDTAVYYCAAAPRPKRVSVSYFSTASNYDWGQGTLVTVSS |
| DKK1-512 | 2258 | EVQLVESGGGLVQPGGSLRLSCAASGGTFNVYAMGWFRQAPGKEREFVAAINRSGKSTYYADSVKGRFTISADNSKNTAYLQMNSLKPEDTAVYYCAAAPRPKRVSVRYFSTSSNYDWGQGTLVTVSS |

TABLE 7

Variable Light Chain Domain Sequences

| DKK1 Variant | SEQ ID NO | VH Sequence |
|---|---|---|
| DKK1-212 | 713 | DIQMTQSPSSLSASVGDRVTITCSGDKLRNKYASWYQQKPGKAPKLLIYGASTLQSGVPSRFSGSGSGTDFTLTISSLQPEDFATYYCQSYDDHDRIVFGQGTKVEIK |

TABLE 7-continued

Variable Light Chain Domain Sequences

| DKK1 Variant | SEQ ID NO | VH Sequence |
|---|---|---|
| DKK1-213 | 714 | DIQMTQSPSSLSASVGDRVTITCRASQPIGPDLLWYQQKPGKAPKLLIYSASVLQSGVPSRFSGSGSGTDFTLTISSLQPEDFATYYCQQSYSTPTFGQGTKVEIK |
| DKK1-214 | 715 | DIQMTQSPSSLSASVGDRVTITCRASQSISSYVNWYQQKPGKAPKLVIYGRNKRPSGVPSRFSGSGSGTDFTLTISSLQPEDFATYYCQQSYSSPLTFGQGTKVEIK |
| DKK1-215 | 716 | DIQMTQSPSSLSASVGDRVTITCRTSQDISNYLNWYQQKPGKAPKLLIYAASDLESGVPSRFSGSGSGTDFTLTISSLQPEDFATYYCQQYYNLPWTFGQGTKVEIK |
| DKK1-216 | 717 | DIQMTQSPSSLSASVGDRVTITCRASQDIYQNLDWYQQKPGKAPKLLIYAASGLPSGVPSRFSGSGSGTDFTLTISSLQPEDFATYYCASRDRSGHGVFGQGTKVEIK |
| DKK1-217 | 718 | DIQMTQSPSSLSASVGDRVTITCRASQPIGPDLLWYQQKPGKAPKLLIYGASSRATGVPSRFSGSGSGTDFTLTISSLQPEDFATYYCQQSYNTPLTFGQGTKVEIK |
| DKK1-218 | 719 | DIQMTQSPSSLSASVGDRVTITCRASQSIRRYLNWYQQKPGKAPKLLIYGRNKRPSGVPSRFSGSGSGTDFTLTISSLQPEDFATYYCQHSYRSGRAFGQGTKVEIK |
| DKK1-219 | 720 | DIQMTQSPSSLSASVGDRVTITCRASQDVSSGVAWYQQKPGKAPKLLIYDASSLHTGVPSRFSGSGSGTDFTLTISSLQPEDFATYYCKQSYTLRTFGQGTKVEIK |
| DKK1-220 | 721 | DIQMTQSPSSLSASVGDRVTITCRPSQRISRYLNWYQQKPGKAPKLLIYGKKNRPSGVPSRFSGSGSGTDFTLTISSLQPEDFATYYCQQSYSPPLTFGQGTKVEIK |
| DKK1-221 | 722 | DIQMTQSPSSLSASVGDRVTITCRASQTIGDYLNWYQQKPGKAPKLLIYHTSRLHSGVPSRFSGSGSGTDFTLTISSLQPEDFATYYCGQDYTSPRTFGQGTKVEIK |
| DKK1-222 | 723 | DIQMTQSPSSLSASVGDRVTITCRASQTIERRLNWYQQKPGKAPKLLIYQDFKRPSGVPSRFSGSGSGTDFTLTISSLQPEDFATYYCQQSRTFGQGTKVEIK |
| DKK1-223 | 724 | DIQMTQSPSSLSASVGDRVTITCRASQSIRRYLNWYQQKPGKAPKLLIYGKKNRPSGVPSRFSGSGSGTDFTLTISSLQPEDFATYYCQQSYSTPSFGQGTKVEIK |
| DKK1-224 | 725 | DIQMTQSPSSLSASVGDRVTITCRASQTIERRLNWYQQKPGKAPKLLIYGNNNRPSGVPSRFSGSGSGTDFTLTISSLQPEDFATYYCSSWAGSRSGTVFGQGTKVEIK |
| DKK1-225 | 726 | DIQMTQSPSSLSASVGDRVTITCRASQNIRSYLNWYQQKPGKAPKLLIYATSNLASGVPSRFSGSGSGTDFTLTISSLQPEDFATYYCNSRDTSINHPVIFGQGTKVEIK |
| DKK1-226 | 727 | DIQMTQSPSSLSASVGDRVTITCSASQDINKYLNWYQQKPGKAPKLLIYDNTNRPSGVPSRFSGSGSGTDFTLTISSLQPEDFATYYCQQSYSTPTFGQGTKVEIK |
| DKK1-227 | 728 | DIQMTQSPSSLSASVGDRVTITCSGDRLGEKYVSWYQQKPGKAPKLLIYDNTNRPSGVPSRFSGSGSGTDFTLTISSLQPEDFATYYCLAWDTRTSGAVFGQGTKVEIK |
| DKK1-228 | 729 | DIQMTQSPSSLSASVGDRVTITCRASQSISSYVNWYQQKPGKAPKLLIYAKNNRPSGVPSRFSGSGSGTDFTLTISSLQPEDFATYYCQSYGSHSNFVVFGQGTKVEIK |
| DKK1-229 | 730 | DIQMTQSPSSLSASVGDRVTITCRASQTIGDYLNWYQQKPGKAPKLLIYAASSLYSGVPSRFSGSGSGTDFTLTISSLQPEDFATYYCQSYDLRYSHVFGQGTKLEIK |
| DKK1-230 | 731 | DIQMTQSPSSLSASVGDRVTITCRASQDIKNYLNWYQQKPGKAPKLLIYGTSYRYSGVPSRFSGSGSGTDFTLTISSLQPEDFATYYCASRSSKGNPHVLFGQGTKVEIK |
| DKK1-231 | 732 | DIQMTQSPSSLSASVGDRVTITCRASQNIRSYLNWYQQKPGKAPKLLIYGKNIRPSGVPSRFSGSGSGTDFTLTISSLQPEDFATYYCQQRARHPHTFGQGTKVEIK |
| DKK1-232 | 733 | DIQMTQSPSSLSASVGDRVTITCSGDNLRSYYVHWYQQKPGKAPKLLIYQDFKRPSGVPSRFSGSGSGTDFTLTISSLQPEDFATYYCQSYDDHDRIVFGQGTKVEIK |
| DKK1-233 | 734 | DIQMTQSPSSLSASVGDRVTITCTGDKLAEKYVSWYQQKPGKAPKLLIYDNNIRPSGVPSRFSGSGSGTDFTLTISSLQPEDFATYYCLAWDTRTSGAVFGQGTKVEIK |
| DKK1-234 | 735 | DIQMTQSPSSLSASVGDRVTITCRASSSVSYMHWYQQKPGKAPKLLIYAASTLQRGVPSRFSGSGSGTDFTLTISSLQPEDFATYYCQQGKTLPLTFGQGTKVEIK |
| DKK1-235 | 736 | DIQMTQSPSSLSASVGDRVTITCRASQSISSYVNWYQQKPGKAPKLLIYAVTSLASGVPSRFSGSGSGTDFTLTISSLQPEDFATYYCQQSTILPLTFGQGTKVEIK |
| DKK1-236 | 737 | DIQMTQSPSSLSASVGDRVTITCRASQSIRRYLNWYQQKPGKAPKLLIYGRNKRPSGVPSRFSGSGSGTDFTLTISSLQPEDFATYYCQQRARHPHTFGQGTKVEIK |

TABLE 7-continued

Variable Light Chain Domain Sequences

| DKK1 Variant | SEQ ID NO | VH Sequence |
|---|---|---|
| DKK1-237 | 738 | DIQMTQSPSSLSASVGDRVTITCRASQTIERRLNWYQQKPGKAPKLLIYDDIDRPSGVPSRFSGSGSGTDFTLTISSLQPEDFATYYCQQGSSLPLTFGQGTKVEIK |
| DKK1-238 | 739 | DIQMTQSPSSLSASVGDRVTITCSGGSGSYGWYQQKPGKAPKLLIYGNNNRPSGVPSRFSGSGSGTDFTLTISSLQPEDFATYYCNSRDTSGNHRVFGQGTKVEIK |
| DKK1-239 | 740 | DIQMTQSPSSLSASVGDRVTITCRTSQDISNYLNWYQQKPGKAPKLLIYQNDKRPSGVPSRFSGSGSGTDFTLTISSLQPEDFATYYCNSRDTSGNHLVFGQGTKVEIK |
| DKK1-240 | 741 | DIQMTQSPSSLSASVGDRVTITCRASQDIYQNLDWYQQKPGKAPKLLIYQNDKRPSGVPSRFSGSGSGTDFTLTISSLQPEDFATYYCQQTYSTRTFGQGTKVEIK |
| DKK1-241 | 742 | DIQMTQSPSSLSASVGDRVTITCRASQSISSYVNWYQQKPGKAPKLLIYGRNKRPSGVPSRFSGSGSGTDFTLTISSLQPEDFATYYCQAWGSSTVIFGQGTKVEIK |
| DKK1-242 | 743 | DIQMTQSPSSLSASVGDRVTITCRASQSIRRYLNWYQQKPGKAPKLLIYRKSNRPSGVPSRFSGSGSGTDFTLTISSLQPEDFATYYCQQRAHPHTFGQGTKVEIK |
| DKK1-243 | 744 | DIQMTQSPSSLSASVGDRVTITCTSSQSLFNVRSQKNYLAWYQQKPGKAPKLLIYDTSKVASGVPSRFSGSGSGTDFTLTISSLQPEDFATYYCSSRDNSDNHLVVFGQGTKVEIK |
| DKK1-244 | 745 | DIQMTQSPSSLSASVGDRVTITCRASQSIRRYLNWYQQKPGKAPKLLIYGKNIRPSGVPSRFSGSGSGTDFTLTISSLQPEDFATYYCQQSYSAPLTFGQGTKVEIK |
| DKK1-245 | 746 | DIQMTQSPSSLSASVGDRVTITCTGDKLAEKYVSWYQQKPGKAPKLLIYHTSRLQSGVPSRFSGSGSGTDFTLTISSLQPEDFATYYCQVWDTGTVVFGQGTKVEIK |
| DKK1-246 | 747 | DIQMTQSPSSLSASVGDRVTITCSASQDINKYLNWYQQKPGKAPKLLIYDNNRPSGVPSRFSGSGSGTDFTLTISSLQPEDFATYYCQQSYSTPTFGQGTKVEIK |
| DKK1-247 | 748 | DIQMTQSPSSLSASVGDRVTITCRASQPIAYFLSWYQQKPGKAPKLLIYGKNIRPSGVPSRFSGSGSGTDFTLTISSLQPEDFATYYCASRSSKGNPHVLFGQGTKVEIK |
| DKK1-248 | 749 | DIQMTQSPSSLSASVGDRVTITCKASDHIGKFLTWYQQKPGKAPKLLIYAASTLQRGVPSRFSGSGSGTDFTLTISSLQPEDFATYYCQQSYETPLTFGQGTKVEIK |
| DKK1-249 | 750 | DIQMTQSPSSLSASVGDRVTITCRASQSISSYVNWYQQKPGKAPKLLIYAVTSLASGVPSRFSGSGSGTDFTLTISSLQPEDFATYYCQQSTIMPLTFGQGTKVEIK |
| DKK1-250 | 751 | DIQMTQSPSSLSASVGDRVTITCRASQSIRRYLNWYQQKPGKAPKLLIYRKSNRPSGVPSRFSGSGSGTDFTLTISSLQPEDFATYYCQQSYSTPTFGQGTKVEIK |
| DKK1-251 | 752 | DIQMTQSPSSLSASVGDRVTITCQASQSISSYLAWYQQKPGKAPKLLIYQNDKRPSGVPSRFSGSGSGTDFTLTISSLQPEDFATYYCQQRDTTPWTFGQGTKVEIK |
| DKK1-252 | 753 | DIQMTQSPSSLSASVGDRVTITCRASQDIKNYYKWYQQKPGKAPKLLIYENNNRPSGVPSRFSGSGSGTDFTLTISSLQPEDFATYYCQARDRNTYVAFGQGTKVEIK |
| DKK1-253 | 754 | DIQMTQSPSSLSASVGDRVTITCRASQYIGTALNWYQQKPGKAPKLLIYDNNIRPSGVPSRFSGSGSGTDFTLTISSLQPEDFATYYCNSRDTSGLHYVFGQGTKVEIK |
| DKK1-254 | 755 | DIQMTQSPSSLSASVGDRVTITCRASQSISGYLNWYQQKPGKAPKLLIYGQHNRPSGVPSRFSGSGSGTDFTLTISSLQPEDFATYYCQQYDAYPPTFGQGTKVEIK |
| DKK1-255 | 756 | DIQMTQSPSSLSASVGDRVTITCRASQSIGRYMNWYQQKPGKAPKLLIYGKNIRPSGVPSRFSGSGSGTDFTLTISSLQPEDFATYYCQQSYSAPLTFGQGTKVEIK |
| DKK1-256 | 757 | DIQMTQSPSSLSASVGDRVTITCRASQDIYQNLDWYQQKPGKAPKLLIYEDTKRPSGVPSRFSGSGSGTDFTLTISSLQPEDFATYYCLQYASSPFTFGQGTKVEIK |
| DKK1-257 | 758 | DIQMTQSPSSLSASVGDRVTITCRASQPIGPDLLWYQQKPGKALKLLIYAVTSLASGVPSRFSGSGFGTDFTLTISSLQPEDFATYYCQQSFSVPAFGQGTKVEIK |
| DKK1-258 | 759 | DIQMTQSPSSLSASVGDRVTITCRASQPIGPDLLWYQQKPGKAPKLLIYGASSRATGVPSRFSGSGSGTDFTLTISSLQPEDFATYYCQQSYNTPLTFGQGTKVEIK |
| DKK1-259 | 760 | DIQMTQSPSSLSASVGDRVTITCSASQDINKYLNWYQQKPGKAHKLMIYDNNNRPSGVPSRFSGSGCGTDFTLTISSLQPEDFATYYCQQSYSTPTFGQGTKVEIK |
| DKK1-260 | 761 | DIQMTQSPSSLSASVGDRVTITCRASQRISSFLNWYQQKPGKAPKLLIYRKSNRPSGVPSRFSGSGSGTDFTLTISSLQPEDFATYYCSQSTRVPPTFGQGTKVEIK |
| DKK1-261 | 762 | DIQMTQSPSSLSASVGDRVTITCRPNQNIATYINWYQQKPGKAPKLLIYHTSRLQSGVPSRFSGSGSGTDFTLTISSLQPEDFATYYCSSWAGSRSGTVFGQGTKVEIK |

TABLE 7-continued

Variable Light Chain Domain Sequences

| DKK1 Variant | SEQ ID NO | VH Sequence |
|---|---|---|
| DKK1-262 | 763 | DIQMTQSPSSLSASVGDRVTITCSGDLRNKYASWYQQKPGKAPKLLIYGQHNRPSGVPSRFSGSGSGTDFTLTISSLQPEDFATYYCSSGSRSGTVFGQGTKVEIK |
| DKK1-263 | 764 | DIQMTQSPSSLSASVGDRVTITCRASQPIGPDLLWYQQKPGKAPKLLIYANTNGPSGVPSRFSGSGSGTDFTLTISSLQPEDFATYYCQQSYSAPYTFGQGTKVEIK |
| DKK1-264 | 765 | DIQMTQSPSSLSASVGDRVTITCQASQSIYSFLSWYQQKPGKAPKLLIYRKSNRPSGVPSRFSGSGSGTDFTLTISSLQPEDFATYYCQQTATWPFTFGQGTKVEIK |
| DKK1-265 | 766 | DIQMTQSPSSLSASVGDRVTITCSASQDINKYLNWYQQKPGKAPKLLIYDNTNRPSGVPSRFSGSGSGTDFTLTISSLQPEDFATYYCQQSYSTPTFGQGTKVEIK |
| DKK1-266 | 767 | DIQMTQSPSSLSASVGDRVTITCKASDHIGKFLTWYQQKPGKAPKLLIYHTSRLHSGVPSRFSGSGSGTDFTLTISSLQPEDFATYYCQQSYKYPLTFGQGTKVEIK |
| DKK1-267 | 768 | DIQMTQSPSSLSASVGDRVTITCRASHNINSYLNWYQQKPGKAPKLLIYQDFKRPSGVPSRFSGSGSGTDFTLTISSLQPEDFATYYCQQSYSSPLTFGQGTKVEIK |
| DKK1-268 | 769 | DIQMTQSPSSLSASVGDRVTITCSASQDINKYLNWYQQKPGKAPKLLIYDNTNRPSGVPSRFSGSGSGTDFTLTISSLQPEDFATYYCQQSYSTPTFGQGTKVEIK |
| DKK1-269 | 770 | DIQMTQSPSSLSASVGDRVTITCRTSQDISNYLNWYQQKPGKAPKLLIYGTSYRYSGVPSRFSGSGSGTDFTLTISSLQPEDFATYYCQQGYTLPWTFGQGTKVEIK |
| DKK1-270 | 771 | DIQMTQSPSSLSASVGDRVTITCRANQNIGNFLNWYQQKPGKAPKLLIYHTSRLHSGVPSRFSGSGSGTDFTLTISSLQPEDFATYYCQQSYSAPLTFGQGTKVEIK |
| DKK1-271 | 772 | DIQMTQSPSSLSASVGDRVTITCSASSSVTYMHWYQQKPGKAPKLLIYHDNKRPSGVPSRFSGSGSGTDFTLTISSLQPEDFATYYCQQSYDNPLTFGQGTKVEIK |
| DKK1-272 | 773 | DIQMTQSPSSLSASVGDRVTITCRASQDIYQNLDWYQQKPGKAPKLLIYQNDKRPSGVPSRFSGSGSGTDFTLTISSLQPEDFATYYCLQFDHTPFTFGQGTKVEIK |
| DKK1-273 | 774 | DIQMTQSPSSLSASVGDRVTITCRTSQDIGNYLNWYQQKPGKAPKLLIYHTSRLHSGVPSRFSGSGSGTDFTLTISSLQPEDFATYYCQQGYRFPLTFGQGTKVEIK |
| DKK1-274 | 775 | DIQMTQSPSSLSASVGDRVTITCRASQPIAYFLSWYQQKPGKAPKLLIYGKNIRPSGVPSRFSGSGSGTDFTLTISSLQPEDFATYYCASRSSKGNPHVLFGQGTKVEIK |
| DKK1-275 | 776 | DIQMTQSPSSLSASVGDRVTITCSGDNLRGYYASWYQQKPGKAPKLLIYQDFKRPSGVPSRFSGSGSGTDFTLTISSLQPEDFATYYCQQSYSPLTFGQGTKVEIK |
| DKK1-276 | 777 | DIQMTQSPSSLSASVGDRVTITCRSSQLVHSTGNTYLHWYQQKPGKAPKLLIYGASSRATGVPSRFSGSGSGTDFTLTISSLQPEDFATYYCSQSTHVPTFGQGTKVEIK |
| DKK1-277 | 778 | DIQMTQSPSSLSASVGDRVTITCQGASLRNYYASWYQQKPGKAPKLLIYENNRPSGVPSRFSGSGSGTDFTLTISSLQPEDFATYYCSTRSRKGNPHVLFGQGTKVEIK |
| DKK1-278 | 779 | DIQMTQSPSSLSASVGDRVTITCRASQDIKNYLNWYQQKPGKAPKLLIYQASSLQSGVPSRFSGSGSGTDFTLTISSLQPEDFATYYCQQSYSPPLTFGQGTKVEIK |
| DKK1-279 | 780 | DIQMTQSPSSLSASVGDRVTITCRASQDVSSGVAWYQQKPGKAPKLLIYDDIDRPSGVPSRFSGSGSGTDFTLTISSLQPEDFATYYCHQRSSYPWTFGQGTKVEIK |
| DKK1-280 | 781 | DIQMTQSPSSLSASVGDRVTITCRASQGVRTSLAWYQQKPGKAPKLLIYSASVLQSGVPSRFSGSGSGTDFTLTISSLQPEDFATYYCQAWDNSAVIFGQGTKVEIK |
| DKK1-281 | 782 | DIQMTQSPSSLSASVGDRVTITCSASQDINKYLNWYQQKPGKAPKLLIYDNTNRPSGVPSRFSGSGSGTDFTLTISSLQPEDFATYYCQQSYSTPTFGQGTKVEIK |
| DKK1-282 | 783 | DIQMTQSPSSLSASVGDRVTITCTGDKLAEKNVSWYQQKPGKAPKLLIYQNDKRPSGVPSRFSGSGSGTDFTLTISSLQPEDFATYYCQQTYSTPLTFGQGTKVEIK |
| DKK1-283 | 784 | DIQMTQSPSSLSASVGDRVTITCRASQTIGDYLNWYQQKPGKAPKLLIYAASGLQSGVPSRFSGSGSGTDFTLTISSLQPEDFATYYCQQSNSWPYTFGQGTKVEIK |
| DKK1-284 | 785 | DIQMTQSPSSLSASVGDRVTITCRASQSISSYVNWYQQKPGKAPKLLIYLSSDLQSGVPSRFSGSGSGTDFTLTISSLQPEDFATYYCAQTGTHPTTFGQGTKVEIK |
| DKK1-285 | 786 | DIQMTQSPSSLSASVGDRVTITCRTSQSLSSYLHWYQQKPGKAPKLLIYEDTKRPSGVPSRFSGSGSGTDFTLTISSLQPEDFATYYCHTWHHNPHTGETNHFGQGTKVEIK |

TABLE 7-continued

Variable Light Chain Domain Sequences

| DKK1 Variant | SEQ ID NO | VH Sequence |
|---|---|---|
| DKK1-286 | 787 | DIQMTQSPSSLSASVGDRVTITCSASQDINKYLNWYQQKPGKAPKLLIYDNTNRPSGVPSRFSGSGSGTDFTLTISSLQPEDFATYYCQQSYSTPTFGQGTKVEIK |
| DKK1-287 | 788 | DIQMTQSPSSLSASVGDRVTITCRASQDVSSGVAWYQQKPGKAPKLLIYGASRLQRGVPSRFSGSGSGTDFTLTISSLQPEDFATYYCNSRDTSGLHYVFGQGTKVEIK |
| DKK1-288 | 789 | DIQMTQSPSSLSASVGDRVTITCRASQTIERRLNWYQQKPGKAPKLLIYENNNRPSGVPSRFSGSGSGTDFTLTISSLQPEDFATYYCQQTYSPPLTFGQGTKVEIK |
| DKK1-289 | 790 | DIQMTQSPSSLSASVGDRVTITCSASQDINKYLNWYQQKPGKAPKLLIYGASSRATGVPSRFSGSGSGTDFTLTISSLQPEDFATYYCQQSYSSPLTFGQGTKVEIK |
| DKK1-290 | 791 | DIQMTQSPSSLSASVGDRVTITCRATQSIRSFLNWYQQKPGKAPKLLIYGQHNRPSGVPSRFSGSGSGIDFTLTISSLQPEDFATYYCQQYYDWPLTFGQGTKVEIK |
| DKK1-291 | 792 | DIQMTQSPSSLSASVGDRVTITCRASQDIYQNLDWYQQKPGKAPKLLIYGKNIRPSGVPSRFSGSGSGTDFTLTISSLQPEDFATYYCQQYYSGWTFGQGTKVEIK |
| DKK1-292 | 793 | DIQMTQSPSSLSASVGDRVTITCRTSQSLSSYLHWYQQKPGKAPKLLIYGRNKRPSGVPSRFSGSGSGTDFTLTISSLQPEDFATYYCQNVLSTPYTFGQGTKVEIK |
| DKK1-293 | 794 | DIQMTQSPSSLSASVGDRVTITCSGDLRNKYASWYQQKPGKAPKLLIYGTSNLESGVPSRFSGSGSGTDFTLTISSLQPEDFATYYCQAWVSSTVVFGQGTKVEIK |
| DKK1-294 | 795 | DIQMTQSPSSLSASVGDRVTITCRASQSVDRYFNWYQQKPGKAPKLLIYSASFLYSGVPSRFSGSGSGTDFTLTISSLQPEDFATYYCSQSTHVPLTFGQGTKVEIK |
| DKK1-295 | 796 | DIQMTQSPSSLSASVGDRVTITCRASQFIGRYFNWYQQKPGKAPKLLIYGRNKRPSGVPSRFSGSGSGTDFTLTISSLQPEDFATYYCQQSYSTPTFGQGTKVEIK |
| DKK1-296 | 797 | DIQMTQSPSSLSASVGDRVTITCRASQPIGPDLLWYQQKPGKAPKLLIYGKKNRPSGVPSRFSGSGSGTDFTLTISSLQPEDFATYYCQQSYSTPRTFGQGTKVEIK |
| DKK1-297 | 798 | DIQMTQSPSSLSASVGDRVTITCRASQTIGDYLNWYQQKPGKAPKLLIYGASRLQRGVPSRFSGSGSGTDFTLTISSLQPEDFATYYCSQSTHVPTFGQGTKVEIK |
| DKK1-298 | 799 | DIQMTQSPSSLSASVGDRVTITCRASQTIERRLNWYQQKPGKAPKLLIYGQHNRPSGVPSRFSGSGSGTDFTLTISSLQPEDFATYYCQQYHSYPPTFGQGTKVEIK |
| DKK1-299 | 800 | DIQMTQSPSSLSASVGDRVTITCRASQSIRRFLNWYQQKPGKAPKLLIYGASSRATGVPSRFSGSGSGTDFTLTISSLQPEDFATYYCQQSFSVPAFGQGTKVEIK |
| DKK1-300 | 801 | DIQMTQSPSSLSASVGDRVTITCRASQDIYQNLDWYQQKPGKAPKLLIYGNNNRPSGVPSRFSGSGSGTDFTLTISSLQPEDFATYYCQQSYSAPLTFGQGTKVEIK |
| DKK1-301 | 802 | DIQMTQSPSSLSASVGDRVTITCRPNQNIATYINWYQQKPGKAPKLLIYHDNKRPSGVPSRFSGSGSGTDFTLTISSLQPEDFATYYCLQDYNYPLTFGQGTKVEIK |
| DKK1-302 | 803 | DIQMTQSPSSLSASVGDRVTITCSASQDINKYLNWYQQKPGKAPKLLIYGRNKRPSGVPSRFSGSGSGTDFTLTISSLQPEDFATYYCQQTYNVPPTFGQGTKVEIK |
| DKK1-303 | 804 | DIQMTQSPSSLSASVGDRVTITCRANQNIGNFLNWYQQKPGKAPKLLIYNAKTLPEGVPSRFSGSGSGTDFTLTISSLQPEDFATYYCASRDRSGHGVFGQGTKVEIK |
| DKK1-304 | 805 | DIQMTQSPSSLSASVGDRVTITCRASQTIERRLNWYQQKPGKAPKLLIYQNDKRPSGVPSRFSGSGSGTDFTLTISSLQPEDFATYYCSSRDRSGNHRVFGQGTKVEIK |
| DKK1-305 | 806 | DIQMTQSPSSLSASVGDRVTITCRASQRISSFLNWYQQKPGKAPKLLIYQNDKRPSGVPSRFSGSGSGTDFTLTISSLQPEDFATYYCQQSYSTPTFGQGTKVEIK |
| DKK1-306 | 807 | DIQMTQSPSSLSASVGDRVTITCRASQSISSYVNWYQQKPGKAPKLLIYHDNKRPSGVPSRFSGSGSGTDFTLTISSLQPEDFATYYCAQNLEIPRTFGQGTKVEIK |
| DKK1-307 | 808 | DIQMTQSPSSLSASVGDRVTITCSGDKLGDKYAYWYQQKPGKAPKLLIYHDNKRPSGVPSRFSGSGSGTDFTLTISSLQPEDFATYYCQPSFYFPYTFGQGTKVEIK |
| DKK1-308 | 809 | DIQMTQSPSSLSASVGDRVTITCRASQDIYQNLDWYQQKPGKAPKLLIYGKNIRPSGVPSRFSGSGSGTDFTLTISSLQPEDFATYYCQQYYSGWTFGQGTKVEIK |
| DKK1-309 | 810 | DIQMTQSPSSLSASVGDRVTITCQASQSISSYLAWYQQKPGKAPKLLIYGASTLQSGVPSRFSGSGSGTDFTLTISSLQPEDFATYYCQQYWAFPVTFGQGTKVEIK |
| DKK1-310 | 811 | DIQMTQSPSSLSASVGDRVTITCRASQSISGYLNWYQQKPGKAPKLLIYAKNNRPSGVPSRFSGSGSGTDFTLTISSLQPEDFATYYCQQSYSSPRTFGQGTKVEIK |

TABLE 7-continued

Variable Light Chain Domain Sequences

| DKK1 Variant | SEQ ID NO | VH Sequence |
|---|---|---|
| DKK1-311 | 812 | DIQMTQSPSSLSASVGDRVTITCSASQDINKYLNWYQQKPGKAPKLLIYDTSKVASGVPSRFSGSGSGTDFTLTISSLQPEDFATYYCQQSYSTPNTFGQGTKVEIK |
| DKK1-312 | 813 | DIQMTQSPSSLSASVGDRVTITCRASQNIRSYLNWYQQKPGKAPKLLIYDNNIRPSGVPSRFSGSGSGTDFTLTISSLQPEDFATYYCLQDYNLWTFGQGTKVEIK |
| DKK1-313 | 814 | DIQMTQSPSSLSASVGDRVTITCRASQSIREYLHWYQQKPGKAPKLLIYATSNLASGVPSRFSGSGSGTDFTLTISSLQPEDFATYYCQAWDTSTAVFGQGTKVEIK |
| DKK1-314 | 815 | DIQMTQSPSSLSASVGDRVTITCSGDLGEKYVSWYQQKPGKAPKLLIYATSTLQSGVPSRFSGSGSGTDFTLTISSLQPEDFATYYCQAWASSTVVFGQGTKVEIK |
| DKK1-315 | 816 | DIQMTQSPSSLSASVGDRVTITCRPNQNIATYINWYQQKPGKAPKLLIYGNNNRPSGVPSRFSGSGSGTDFTLTISSLQPEDFATYYCSTRSSKGNPHVLFGQGTKVEIK |
| DKK1-316 | 817 | DIQMTQSPSSLSASVGDRVTITCRASKVSTSGYVYMHWYQQKPGKAPKLLIYENNNRPSGVPSRFSGSGSGTDFTLTISSLQPEDFATYYCQQYWAFPVTFGQGTKVEIK |
| DKK1-317 | 818 | DIQMTQSPSSLSASVGDRVTITCRASSSVSYMHWYQQKPGKAPKLLIYGENSRPSGVPSRFSGSGSGTDFTLTISSLQPEDFATYYCQQSYSTPWTFGQGTKVEIK |
| DKK1-318 | 819 | DIQMTQSPSSLSASVGDRVTITCRASQDVSSGVAWYQQKPGKAPKLLIYGSSLQSGVPSRFSGSGSGTDFTLTISSLQPEDFATYYCQQYHSYPPTFGQGTKVEIK |
| DKK1-319 | 820 | DIRMTQSPSSLSASVGDRVTITCRASQSVDRYFNWYQQKPGKAPKLLIYHTSRLHSGVPSRFSGSGSGTDFTLTISSLQPEDFATYYCQAWDNRAVVFGQGTKVEIK |
| DKK1-320 | 821 | DIQMTQSPSSLSASVGDRVTITCQSSQSVYSNNELSWYQQKPGKAPKLLIYGNNNRPSGVPSRFSGSGSGTDFTLTISSLQPEDFATYYCQQSYSTPTFGQGTKVEIK |
| DKK1-321 | 822 | DIQMTQSPSSLSASVGDRVTITCRSSQSISTYLNWYQQKPGKAPKLLIYAASRSQSGVPSRFSGSGSGTDFTLTISSLQPEDFATYYCQQNYIIPWTFGGGTKVEIK |
| DKK1-322 | 823 | DIQMTQSPSSLSASVGDRVTITCRASHSISSYLNWYQQKPGKAPKLLIYTASRLRSGVPSRFSGSGSGTDFTLTISSLQPEDFATYYCQQNYNTPFTFGGGTKVEIK |
| DKK1-323 | 824 | DIQMTQSPSSLSASVGDRVTITCRASQSIHSYLNWYQQKPGKAPKLLIYTASALQTGVPSRFSGSGSGTDFTLTISSLQPEDFATYYCQQSFSSPLTFGQGTKVEIK |
| DKK1-324 | 825 | DIQMTQSPSSLSASVGDRVTITCRAGQSVSRFLNWYQQKPGKAPKLLIYAAATLQSGVPSRFSGSGSGTDFTLTISSLQPEDFATYYCQQSYDTPFTFGGGTKVEIK |
| DKK1-325 | 826 | DIQMTQSPSSLSASVGDRVTITCRTSQSIGTYLNWYQQKPGKSPKLLIYDASILQSGVPSRFSGSGSGTDFTLTISSLQPEDFATYYCQQNYNTPLTFGGGTKVEIK |
| DKK1-326 | 827 | DIQMTQSPSSLSASVGDRVTITCRASQSIGIHLNWYQQKPGKAPKLLIYGATSLESGVPSRFSGSGSGTDFTLTISSLQPEDFATYYCQQSYNTPPYTFGGGTKVEIK |
| DKK1-327 | 828 | DIQMTQSPSSLSASVGDRVTITCRASQSIRSYLNWYQQKPGKAPKLLIYATSRLESGVPSRFSGSGSGTDFTLTISSLQPEDFATYYCQQGYTSPLTFGGGTKVEIK |
| DKK1-328 | 829 | DIQMAQSPSSLSASVGDRVTITCRASQGIATYLNWYQQKPGKAPKLLIYGASTLRTGVPSRFSGSGSGTDFTLTISSLQPEDFATYYCQQTFTNTPLTFGGGTKVEIK |
| DKK1-329 | 830 | DIQMTQSPSSLSASVGDRVTITCRASQSIGSYLNWYQQKPGKAPKLLIYAASSLKSGVPSRFSGSGSGTDFTLTISSLQPEDFATYYCQQSHNIPRTFGGGTKVEIK |
| DKK1-330 | 831 | DIQMTQSPSSLSASVGDRVTITCRASQSISRNLNWYQQKPGKAPKLLIYGASRLHSGVPSRFSGSGSGTDFTLTISSLQPEDFATYYCQQGYITPQTFGGGTKVEIK |
| DKK1-331 | 832 | DIQMTQSPSSLSASVGDRVTITCRASQSVRTYLNWYQQKPGKAPKLLIYRASRLQSGVPSRFSGSGSGTDFTLTISSLQPEDFATYYCQQSFTTPLTFGGGTKVEIK |
| DKK1-332 | 833 | DIQMTQSPSSLSASVGDRVTITCRASQSIGSHLSWYQQKPGKAPKLLIYRASRLQSGVPSRFSGSGSGTDFTLTISSLQPEDFATYYCQQSYSPPITFGGGTKVEIK |
| DKK1-333 | 834 | DIQMTQSPSSLSASVGDRVTITCRASQSISRYLNWYQQKPGKAPKLLIYGASKLQRGVPSRFSGSGSGTDFTLTISSLQPEDFATYYCQQSSSVPWTFGGGTKVEIK |
| DKK1-334 | 835 | DIQMTQSPSSLSASVGDRVTITCRASQNIGNYLNWYQQKPGKAPKLLIYAASTLASGVPSRFSGSGSGTDFTLTISSLQPEDFATYYCQQNYNTPLTFGGGTKVEIK |

TABLE 7-continued

Variable Light Chain Domain Sequences

| DKK1 Variant | SEQ ID NO | VH Sequence |
|---|---|---|
| DKK1-335 | 836 | DIQMTQSPSSLSASVGDRVTITCRSSQSISTYLNWYQQKPGKAPKLLIYAASRLESGVPSRFSGSGSGTDFTLTISSLQPEDFATYYCQQSYTPPITFGGGTKVEIK |
| DKK1-336 | 837 | DIQMTQSPSSLSASVGDRVTITCRASQNIGSYLNWYQQKPGKAPKLLIYAASKLHSGVPSRFSGSGSGTDFTLTISSLQPEDFATYYCQQSYNTPVTFGGGTKVEIK |
| DKK1-337 | 838 | DIQMTQSPSSLSASVGDRVTITCRASQSISRFLNWYQQKPGKAPKLLIYGASALQTGVPSRFSGSGSGTDFTLTISSLQPEDFATYYCQQSYIPPLTFGGGTKVEIK |
| DKK1-338 | 839 | DIQMTQSPSSLSASVGDRVTITCRASESITTYLNWYQQKPGKAPKLLIYTASSLQSGVPSRFSGSGSGTDFTLTISSLQPEDFATYYCQQNYITPLTFGGGTKVEIK |
| DKK1-339 | 840 | DIQMTQSPSSLSASVGDRVTITCRASQSISTYLHWYQQKPGKAPKLLIYAASTLHSGVPSRFSGSGSGTDFTLTISSLQPEDFATYYCQQSYNSITFGGGTKVEIK |
| DKK1-340 | 841 | DIQMTQSPSSLSASVGDRVTITCRSSQSIGSNLNWYQQKPGKAPKLLIYATSNLQSGVPSRFSGSGSGTDFTLTISSLQPEDFATYYCQQSYRIPRTFGGGTKVEIK |
| DKK1-341 | 842 | DIQMTQSPSSLPASVGDRVTITCRASQSISRYLSWYQQKPGKAPKLLIYAASRLRSGVPSRFSGSGSGTDFTLTISSLQPEDFATYYCQQSYSTPTTFGGGTKVEIK |
| DKK1-342 | 843 | DIQMTQSPSSLSASVGDRVTITCRASQYIGTYLNWYQQKPGKAPKLLIYAASNLQRGVPSRFSGSGSGTDFTLTISSLQPEDFATYYCQQSYSDLTFGGGTKVEIK |
| DKK1-343 | 844 | DIQMTQSPSSLSASVGDRVTITCRASESISRNLNWYQQKPGKAPKLLIYAASSLRSGVPSRFSGSGSGTDFTLTISSLQPEDFATYYCQQSYSGPPYTFGGGTKVEIK |
| DKK1-344 | 845 | DIQMTQSPSSLSASVGDRVTITCRSSQSISTYLNWYQQKPGKAPKLLIYAASRSQSGVPSRFSGSGSGTDFTLTISSLQPEDFATYYCQQNYIIPWTFGGGTKVEIK |
| DKK1-345 | 846 | DIQMTQSPSSLSASVGDRVTITCRASQSVSNFLNWYQQKPGKAPKLLIYGASNLHSGVPSRFSGSGSGTDFTLTISSLQPEDFATYYCQQSYSFPFSFGGGTKVEIK |
| DKK1-346 | 847 | DIQMTQSPSSLSASVGDRVTITCRASRNIRTYLNWYQQKPGKAPKLLIYRASTLQSGVPSRFSGSGSGTDFTLTISSLQPEDFATYYCQQSYKTPVTFGGGTKVEIK |
| DKK1-347 | 848 | DIQMTQSPSSLSASVGDRVTITCRASQSIGNFLNWYQQKPGKAPKLLIYRASRLQSGVPSRFSGSGSGTDFTLTISSLQPEDFATYYCQQSYNTPITFGGGTKVEIK |
| DKK1-348 | 849 | DIQMTQSPSSLSASVGDRVTITCRASQSIRSYLNWYQQKPGKAPKLLIYGATNLQSGVPSRFSGSGSGTDFTLTISSLQPEDFATYYCQQSYSTLPFTFGGGTKVEIK |
| DKK1-349 | 850 | DIQMTQSPSSLSASVGDRVTITCRASQSIRTYLNWYQQKPGKAPKLLIYGAVNLQSGVPSRFSGSGSGTDFTLTISSLQPEDFATYYCQQRDTFGGGTKVEIK |
| DKK1-350 | 851 | DIQMTQSPSSLSASVGDRVTITCRASQNIYTYLNWYQQKPGKAPKPLIYLASSLQSGVPSRFSGSGSGTDFTLTISSLQPEDFATYYCQQSYSTRFTFGGGTKVEIK |
| DKK1-351 | 852 | DIQMTQSPSSLSASVGDRVTITCRASQSISRYLSWYQQKPGKAPKLLIYGSSNLQSGVPSRFSGSGSGTDFTLTISSLQPEDFATYYCQQSYSSPTFGGGTKVEIK |
| DKK1-352 | 853 | DIQMTQSPSSLSASVGDRVTITCRASQNIGRYLNWYQQKPGKAPKLLIYSASKLQSGVPSRFSGSGSGTDFTLTISSLQPEDFATYYCQQTYSPPLTFGGGTKVEIK |
| DKK1-353 | 854 | DIQMTQSPSSLSASVGDRVTITCRASQTISAYLNWYQQKPGKAPKLLIYGASSVQSGVPSRFSGSGSGTDFTLTISSLQPEDFATYYCQQSYSGLTFGGGTKVEIK |
| DKK1-354 | 855 | DIQMTQSPSSLSASVGDRVTITCRASQSIRGYLNWYQQKPGKAPKLLIYSTSSLQSGVPSRFSGSGSGTDFTLTISSLQPEDFATYYCQQNYNTPLTFGGGTKVEIK |
| DKK1-355 | 856 | DIQMTQYPSSLSASVGDRVTITCRASQSVSYYLNWYQQKPGKAPKLLIYGSSNLQSGVPSRFSGSGSGTDFTLTISSLQPEDFATYYCQQTYSSPVTFGGGTKVEIK |
| DKK1-356 | 857 | DIQMTQSPSSLSASVGDRVTITCRASQPISSYLNWYQQKPGKAPKLLIYSASSLRSGVPSRFSGSGSGTDFTLTISSLQPEDFATYYCQQGYSAPLTFGGGTKVEIK |
| DKK1-357 | 858 | DIQMTQSPSSLSASVGDRVTITCQTSQSIGKYLNWYQQKPGKAPKLLIYGASRVQSGVPSRFSGSGSGTDFTLTISSLQPEDFATYYCQQTYSTPLTFGGGTKVEIK |
| DKK1-358 | 859 | DIQMTQSPSSLSASVGDRVTITCRASQSIGAYLNWYQQKPGKAPKLLIYGTSSLQGGVPSRFSGSGSGTDFTLTISSLQPEDFATYYCQQSYGTLITFGGGTKVEIK |
| DKK1-359 | 860 | DIQMTQSPSSLSASVGDRVTITCRASQTISTFLNWYQQKPGKAPKLLIYGASRLQGGVPSRFSGSGSGTDFTLTISSLQPEDFATYYCQQSYSTPLTFGGGTKVEIK |

TABLE 7-continued

Variable Light Chain Domain Sequences

| DKK1 Variant | SEQ ID NO | VH Sequence |
|---|---|---|
| DKK1-360 | 861 | DIQMTQSPSSLSASVGDRVTITCRASQSIGRYLNWYQQKPGKAPKLLIYAVSNLRSGVPSRFSGSGSGTDFTLTISSLQPEDFATYYCQQSYSTPSFGGGTKVEIK |
| DKK1-361 | 862 | DIQMTQSPSSLSASVGDRVTITCRSSQSISNYLNWYQQKPGKAPKLLIYGASRLESGVPSRFSGSGSGTDFTLTISSLQPEDFATYYCQQSYSLPLTFGGGTKVEIK |
| DKK1-362 | 863 | DIQMTQSPSSLSASVGDRVTITCRASQTISRSLNWYQQKPGKAPKLLIYGASRLQSGVPSRFSGSGSGTDFTLTISSLQPEDFATYYCQQSFTTPYTFGGGTKVEIK |
| DKK1-363 | 864 | DIQMTQSPSSLSASVGDRVTITCRASQSISSYLDWYQQKPGKAPKLLIYAASRLQSGVPSRFSGSGSGTDFTLTISSLQPEDFATYYCQQNYRSPLTFGGGTKVEIK |
| DKK1-364 | 865 | DIQMTQSPSSLSASVGDRVTITCRASRSIGTYLNWYQQKPGKAPKLLIYAASKLQSGVPSRFSGSGSGTDFTLTISSLQPEDFATYYCQQNYITPLTFGGGTKVEIK |
| DKK1-365 | 866 | DIQMTQSPSSLSASVGDRVTITCRASQNINRYLNWYQQKPGKAPKLLIYASSRLQSGVPSRFSGSGSGTDFTLTISSLQPEDFATYYCQQSYSSPITFGGGTKVEIK |
| DKK1-366 | 867 | DIQMTQSPSSLSASVGDRVTITCRASQSVSSYLSWYQQKPGKAPKLLIYATSNLQRGVPSRFSGSGSGTDFTLTISSLQPEDFATYYCHQTYSTPRTFGGGTKVEIK |
| DKK1-367 | 868 | DIQMTQSPSSLSASVGDRVTITCRASQSIGIHLNWYQQKPGKAPKLLIYGATSLESGVPSRFSGSGSGTDFTLTISSLQPEDFATYYCQQSYNTPPYTFGGGTKVEIK |
| DKK1-368 | 869 | DIQMTQSPSSLSASVGDRVTITCRASRSISTYLNWYQQKPGKAPKLLIYEVSSLQSGVPSRFSGSGSGTDFTLTISSLQPEDFATYYCQQNYITPLTFGGGTKVEIK |
| DKK1-369 | 870 | DIQMTQSPSSLSASVGDRVTITCRASQSIRYLSWYQQKPGKAPKLLIYAASRLQRGVPSRFSGSGSGTDFTLTISSLQPEDFATYYCQQGYSSPLTFGGGTKVEIK |
| DKK1-370 | 871 | DIQMTQSPSSLSASVGDRVTITCRASQSISNFLSWYQQKPGKAPKLLIYGTSSLQGGVPSRFSGSGSGTDFTLTISSLQPEDFATYYCQQSYSIPFTFGGGTKVEIK |
| DKK1-371 | 872 | DIQMTQSPSSLSASVGDRVTITCRASQGISFYLNWYQQKPGKAPKLLIYAASRLQRGVPSRFSGSGSGTDFTLTISSLQPEDFATYYCQQSYSTPQITFGGGTKVEIK |
| DKK1-372 | 873 | DIQMTQSPSSLSASVGDRVTITCRASQNIKTYLNWYQQKPGKAPKLLIYGASSLESGVPSRFSGSGSGTDFTLTISSLQPEDFATYYCLQTYSVPLTFGGGTKVEIK |
| DKK1-373 | 874 | DIQMTQSPSSLSASVGDRVTITCRASQYISNYLNWYQQKPGKAPKLLIYGASSIQNGVPSRFSGSGSGTDFTLTISSLQPEDFATYYCQQTYSLPLTFGGGTKVEIK |
| DKK1-374 | 875 | DIQMTQSPSSLSASVGDRVTITCRASQTISTFLNWYQQKPGKAPKLLIYGASRLQGGVPSRFSGSGSGTDFTLTISSLQPEDFATYYCQQSYSTPLTFGGGTKVEIK |
| DKK1-375 | 876 | DIQMTQSPSSLSASVGDRVTITCRASQSISRFLNWYQQKPGKAPKLLIYGASRLESGVPSRFSGSGSGTDFTLTISSLQPEDFATYYCQQSYKTPRTFGGGTKVEIK |
| DKK1-376 | 877 | DIQMTQSPSSLSASVGDRVTITCRASESIDNYLNWYQQKPGKAPKLLIYGATSLESGVPSRFSGSGSGTDFTLTISSLQPEDFATYYCQQNYNIPFTFGGGTKVEIK |
| DKK1-377 | 878 | DIQMTQSPSSLSASVGDRVTITCRTSQSISNFLNWYQQKPGKAPKLLIYTASKLQSGVPSRFSGSGSGTDFTLTISSLQPEDFATYYCQQSYRVPRTFGGGTKVEIK |
| DKK1-378 | 879 | DIQMTQSPSSLSASVGDRVTITCRASQSIGTNLNWYQQKPGKAPKLLIYAASALQGGVPSRFSGSGSGTDFTLTISSLQPEDFATYYCQQSYSIPLTFGGGTKVEIK |
| DKK1-379 | 880 | DIQMTQSPSSLSASVGDRVTITCRASQTITRYLNWYQQKPGKAPKLLIYAATSLHSGVPSRFSGSGSGTDFTLTISSLQPEDFATYYCQQSYSTPETFGGGTKVEIK |
| DKK1-380 | 881 | DIQMTQSPSSLSASVGDRVTITCRASQSIGNFLNWYQQKPGKAPKLLIYDASSLQSGVPSRFSGSGSGTDFTLTISSLQPEDFATYYCQQSYSIPPTFGGGTKVEIK |
| DKK1-381 | 882 | DIQMTQSPSSLSASVGDRVTITCRASHSISRYLNWYQQKPGKAPKLLIYGASNLPSGVPSRFSGSGSGTDFTLTISSLQPEDFATYYCQQSYSTHTFGGGTKVEIK |
| DKK1-382 | 883 | DIQMTQSPSSLSASVGDRVTITCRASQGISFYLNWYQQKPGKAPKLLIYGASILQTGVPSRFSGSGSGTDFTLTISSLQPEDFATYYCQQSYSPPLTFGGGTKVEIK |
| DKK1-383 | 884 | DIQMTQSPSSLSASVGDRVTITCRASQSVSNYLNWYQQKPGKAPKLLIYGASTLQAGVPSRFSGSGSGTDFTLTISSLQPEDFATYYCQQSYVTPPTFGGGTKVEIK |

TABLE 7-continued

Variable Light Chain Domain Sequences

| DKK1 Variant | SEQ ID NO | VH Sequence |
|---|---|---|
| DKK1-384 | 885 | DIQMTQSPSSLSASVGDRVTITCRASQSIGSFLNWYQQKPGKAPKLLIYAAFRLQSGVPSRFSGSGSGTDFTLTISSLQPEDFATYYCQQTYSPPFTFGGGTKVEIK |
| DKK1-385 | 886 | DIQMTQSPSSLSASVGDRVTITCRASQSITRHLNWYQQKPGKAPKLLIYAASRLQTGVPSRFSGSGSGTDFTLTISSLQPEDFATYYCQQSYSTPGTFGGGTKVEIK |
| DKK1-386 | 887 | DIQMTQSPSSLSASVGDRVTITCRASQRISRYLNWYQQKPGKAPKLLIYGASNLQGGVPSRFSGSGSGTDFTLTISSLQPEDFATYYCQQSYRTPITFGGGTKVEIK |
| DKK1-387 | 888 | DIQMTQSPSSLSASVGDRVTITCRASQYIGNYLNWYQQKPGKAPKLLIYAVSRLQSGVPSRFSGSGSGTDFTLTISSLQPEDFATYYCQQSFSAPYTFGGGTKVEIK |
| DKK1-388 | 889 | DIQMTQSPSSLSASVGDRVTITCRASQYISTFLNWYQQKPGKAPKLLIYSASRLQNGVPSRFSGSGSGTDFTLTISSLQPEDFATYYCQQSYSPLTFGGGTKVEIK |
| DKK1-389 | 890 | DIQMTQSPSSLSASVGDRVTITCRASRSISRYLNWYQQKPGKAPKLLIYGASILQTGVPSRFSGSGSGTDFTLTISSLQPEDFATYYCQQSYTPPRTFGGGTKVETK |
| DKK1-390 | 891 | DIQMTQSPSSLSASVGDRVTITCRASQSISRSLNWYQQKPGKAPKLLIYGASSLRSGVPSRFSGSGSGTDFTLTISSLQPEDFATYYCQQSFTIPWTFGGGTKVEIK |
| DKK1-391 | 892 | DIQMTQSPSSLSASAGDRVTITCRASQSITSYLNWYQQKPGKAPKLLIYAASRLRSGVPSRFSGSGSGTDFTLTISSLQPEDFATYYCQQSYNTPVTFGGGTKVEIK |
| DKK1-392 | 893 | DIQMTQSPSSLSASVGDRVTITCRASQNIAGYLNWYQQKPGKAPKLLIYAASRLHSGVPSRFSGSGSGTDFTLTISSLQPEDFATYYCQQSSSTPITFGGGTKVEIK |
| DKK1-393 | 894 | DIQMTQSPSSLSASVGDRVTITCRASQTIRTYLNWYQQKPGKAPKLLIYATSSLQTGVPSRFSGSGSGTDFTLTISSLQPEDFATYYCQQSYRPPLTFGGGTKVEIK |
| DKK1-394 | 895 | DIQMTQSPSSLSASVGDRVTITCRASQSIGIHLNWYQQKPGKAPKLLIYGATSLESGVPSRFSGSGSGTDFTLTISSLQPEDFATYYCQQSYNTPPYTFGGGTKVEIK |
| DKK1-395 | 896 | DIQMTQSPSSLSASVGDRVTITCRSSQSISTYLHWYQQKPGKAPKLLIYGASKLQSGVPSRFSGSGSGTDFTLTISSLQPEDFATYYCQQTYSAPRTFGGGTKVEIK |
| DKK1-396 | 897 | DIQMTQSPSSLSASVGDRVTITCRASQSIGRYLNWYQQKPGKAPKLLIYGASRLQSGVPSRFSGSGSGTDFTLTISSLQPEDFATYYCQQSYRTPLTFGGGTKVEIK |
| DKK1-397 | 898 | DIQMTQSPSSLSASVGDRVTITCRASHTISRYLNWYQQKPGKAPRLLIYAASDLQTGVPSRFSGGGSGTDFTLTISSLQPEDFATYYCQQSFTAPDTFGGGTKVEIK |
| DKK1-398 | 899 | DIQMTQSPSSLSASVGDRVTITCRTSQSISRYLNWYQQKPGKAPKLLIYTTSDLQSGVPSRFSGSGSGTDFTLTISSLQPEDFATYYCQQSYSDLTFGGGTKVEIK |
| DKK1-399 | 900 | DIQMTQSPSSLSASVGDRVTITCRASQRINTYLNWYQQKPGKAPKLLIYGAFRLQSGVPSRFSGSGSGTDFTLTISSLQPEDFATYYCQQSYRVPRTFGGGTKVEIK |
| DKK1-400 | 901 | DIQMTQSPSSLSASVGDRVTITCRASQSINHYLNWYQQKPGKAPKLLIYGASRLQSGVPSRFSGSGSGTDFTLTISSLQPEDFATYYCQQSYSLPRTFGGGTKVEIK |
| DKK1-401 | 902 | DIQMTQSPSSLSASVGDRVTITCRASQTIGRYLNWYQQKPGKAPKLLIYATSSLRSGVPSRFSGSGSGTDFTLTISSLQPEDFATYYCQQTYSTPYTFGGGTKVEIK |
| DKK1-402 | 903 | DIQMTQSPSSLSASVGDRVTITCRASQSIGEYLNWYQQKPGKAPKLLIYAASRLQRGVPSRFSGSGSGTDFTLTISSLQPEDFATYYCQQNYRSPLTFGGGTKVEIK |
| DKK1-403 | 904 | DIQMTQSPSSLSASVGDRVTITCRASQSIYRYLNWYQQKPGKAPKLLIYAATTLQSGVPSRFSGSGSGTDFTLTISSLQPEDFATYYCQQSYSPPLTFGGGTKVEIK |
| DKK1-404 | 905 | DIQMTQSPSSLSASVGDRVTITCRASQNIGRYLNWYQQKPGKAPKLLIYEVSSLRSGVPSRFSGSGSGTDFTLTISSLQPEDFATYYCQQSYRTPGTFGGGTKVEIK |
| DKK1-405 | 906 | DIQMTQSPSSLSASVGDRVTITCRAGQSIRNYLNWYQQKPGKAPKLLIYAATTLQSGVPSRFSGSGSGTDFTLTISSLQPEDFATYYCQQSFLTPWTFGGGTKVEIK |
| DKK1-406 | 907 | DIQMTQSPSSLSASVGDRVTITCRASQSISRHLNWYQQKPGKAPKLLIYGATRLQSGVPSRFSGSGSGTDFTLTISSLQPEDFATYYCQQSYSKPYTFGGGTKVEIK |
| DKK1-407 | 908 | DIQMTQSPSSLSASVGDRVTITCRASQSISRYLHWYQQKPGKAPKLLIYAATSLQSGVPSRFSGSGSGTDFTLTISSLQPEDFATYYCQQSYSTPLSFGGGTKVEIK |
| DKK1-408 | 909 | DIQMTQSPSSLSASVGDRVTITCRTSQSIGTYLNWYQQKPGKAPKLLIYDTSNLQGGVPSRFSGSGSGTDFTLAISSLQPEDFATYYCQQSFTSPLTFGGGTKVEIK |

TABLE 7-continued

Variable Light Chain Domain Sequences

| DKK1 Variant | SEQ ID NO | VH Sequence |
|---|---|---|
| DKK1-409 | 910 | DIQMTQSPSSLSASVGDRVTITCRASQGIATYLNWYQQKPGKAPKLLIYAASSLQRGVPSRFSGSGSGTDFTLTISSLQPEDFATYYCQQTHSTPLTFGGGTKVEIK |
| DKK1-410 | 911 | DIQMTQSPSSLSASVGDRVTITCRASQNIGGYLNWYQQKPGKAPKLLIYRASRLQSGVPSRFSGSGSGTDFTLTISSLQPEDFATYYCQQSYSTPLLTFGGGTKVEIK |
| DKK1-411 | 912 | DIQMTQSPSSLSASVGDRVTITCRASQYIGNYLNWYQQKPGKAPKLLIYASSTLQRGVPSRFSGSGSGTDFTLTISSLQPEDFATYYCQQTSSTPLTFGGGTKVEIK |
| DKK1-412 | 913 | DIQMTQSPSSLSASVGDRVTITCRTSQSIGTYLNWYQQKPGKSPKLLIYDASILQSGVPSRFSGSGSGTDFTLTISSLQPEDFATYYCQQNYNTPLTFGGGTKVEIK |
| DKK1-413 | 914 | DIQMTQSPSSLSASVGDRVTITCQASQNIGRYLNWYQQKPGKAPKLLIYAASALQGGVPSRFSGSGSGTDFTLTISSLQPEDFATYYCQQSYTPPRTFGGGTKVEIK |
| DKK1-414 | 915 | DIQMTQSPSSLSASVGDRVTITCRASQSISRHLNWYQQKPGKAPKLLIYGASSLQSGVPSRFSGSGSGTDFTLTISSLQPEDFATYYCQQTYRTPLTFGGGTKVEIK |
| DKK1-415 | 916 | DIQMTQSPSSLSASVGDRVTITCRASQSIHNYLNWYQQKPGKAPKLLIYAASSLHDGVPSRFSGSGSGTDFTLTISSLQPEDFATYYCQQSYSTPYTFGGGTKVEIK |
| DKK1-416 | 917 | DIQMAQSPSSLSASVGDRVTITCRASQGIATYLNWYQQKPGKAPKFLIYGASTLRTGVPSRFSGSGSGTDFTLTISSLQPEDFATYYCQQTFTNTPLTFGGGTKVEIK |
| DKK1-417 | 918 | DIQMTQSPSSLSASVGDRVTITCRASQTITKYLNWYQQKPGKAPKLLIYATSNLQTGVPSRFSGSGSGTDFTLTISSLQPEDFATYYCQQSYSAPVTFGGGTKVEIK |

TABLE 8

Variable Light Chain CDRs

| DKK1 Variant | SEQ ID NO | CDR1 Sequence | CDR2 Sequence | SEQ ID NO | CDR3 Sequence |
|---|---|---|---|---|---|
| DKK1-212 | 2259 | KLRNKY | GAS | 2522 | QSYDDHDRIV |
| DKK1-213 | 2260 | QPIGPD | SAS | 2523 | QQSYSTPT |
| DKK1-214 | 2261 | QSISSY | GRN | 2524 | QQSYSSPLT |
| DKK1-215 | 2262 | QDISNY | AAS | 2525 | QQYYNLPWT |
| DKK1-216 | 2263 | QDIYQN | AAS | 2526 | ASRDRSGHGV |
| DKK1-217 | 2264 | QPIGPD | GAS | 2527 | QQSYNTPLT |
| DKK1-218 | 2265 | QSIRRY | GRN | 2528 | QHSYRSGRA |
| DKK1-219 | 2266 | QDVSSG | DAS | 2529 | KQSYTLRT |
| DKK1-220 | 2267 | QRISRY | GKK | 2530 | QQSYSPPLT |
| DKK1-221 | 2268 | QTIGDY | HTS | 2531 | GQDYTSPRT |
| DKK1-222 | 2269 | QTIERR | QDF | 2532 | QQSRT |
| DKK1-223 | 2270 | QSIRRY | GKK | 2533 | QQSYSTPS |
| DKK1-224 | 2271 | QTIERR | GNN | 2534 | SSWAGSRSGTV |
| DKK1-225 | 2272 | QNIRSY | ATS | 2535 | NSRDTSINHPVI |
| DKK1-226 | 2273 | QDINKY | DNT | 2536 | QQSYSTPT |
| DKK1-227 | 2274 | DRLGEKY | DNT | 2537 | LAWDTRTSGAV |
| DKK1-228 | 2275 | QSISSY | AKN | 2538 | QSYGSHSNFVV |
| DKK1-229 | 2276 | QTIGDY | AAS | 2539 | QSYDLRYSHV |
| DKK1-230 | 2277 | QDIKNY | GTS | 2540 | ASRSSKGNPHVL |
| DKK1-231 | 2278 | QNIRSY | GKN | 2541 | QQRARHPHT |
| DKK1-232 | 2279 | DNLRSYY | QDF | 2542 | QSYDDHDRIV |
| DKK1-233 | 2280 | KLAEKY | DNN | 2543 | LAWDTRTSGAV |
| DKK1-234 | 2281 | SSVSY | AAS | 2544 | QQGKTLPLT |
| DKK1-235 | 2282 | QSISSY | AVT | 2545 | QQSTILPLT |
| DKK1-236 | 2283 | QSIRRY | GRN | 2546 | QQRARHPHT |
| DKK1-237 | 2284 | QTIERR | DDI | 2547 | QQGSSLPLT |
| DKK1-238 | 2285 | SGS | GNN | 2548 | NSRDTSGNHRV |
| DKK1-239 | 2286 | QDISNY | QND | 2549 | NSRDTSGNHLV |
| DKK1-240 | 2287 | QDIYQN | QND | 2550 | QQTYSTRT |
| DKK1-241 | 2288 | QSISSY | GRN | 2551 | QAWGSSTVI |
| DKK1-242 | 2289 | QSIRRY | RKS | 2552 | QQRARHPHT |
| DKK1-243 | 2290 | QSLFNVRSQKNY | DTS | 2553 | SSRDNSDNHLVV |
| DKK1-244 | 2291 | QSIRRY | GKN | 2554 | QQSYSAPLT |
| DKK1-245 | 2292 | KLAEKY | HTS | 2555 | QVWDTGTVV |
| DKK1-246 | 2293 | QDINKY | DNN | 2556 | QQSYSTPT |

TABLE 8-continued

Variable Light Chain CDRs

| DKK1 Variant | SEQ ID NO | CDR1 Sequence | SEQ ID NO | CDR2 Sequence | SEQ ID NO | CDR3 Sequence |
|---|---|---|---|---|---|---|
| DKK1-247 | 2294 | QPIAYF | | GKN | 2557 | ASRSSKGNPHVL |
| DKK1-248 | 2295 | DHIGKF | | AAS | 2558 | QQSYETPLT |
| DKK1-249 | 2296 | QSISSY | | AVT | 2559 | QQSTIMPLT |
| DKK1-250 | 2297 | QSIRRY | | RKS | 2560 | QQSYSTPT |
| DKK1-251 | 2298 | QSISSY | | QND | 2561 | QQRDTTPWT |
| DKK1-252 | 2299 | QDIKNY | | ENN | 2562 | QARDRNTYVA |
| DKK1-253 | 2300 | QYIGTA | | DNN | 2563 | NSRDTSGLHYV |
| DKK1-254 | 2301 | QSISGY | | GQH | 2564 | QQYDAYPPT |
| DKK1-255 | 2302 | QSIGRY | | GK | 2565 | QQSYSAPLT |
| DKK1-256 | 2303 | QDIYQN | | EDT | 2566 | LQYASSPFT |
| DKK1-257 | 2304 | QPIGPD | | AVT | 2567 | QQSFSVPA |
| DKK1-258 | 2305 | QPIGPD | | GAS | 2568 | QQSYNTPLT |
| DKK1-259 | 2306 | QDINKY | | DNN | 2569 | QQSYSTPT |
| DKK1-260 | 2307 | QRISSF | | RKS | 2570 | SQSTRVPPT |
| DKK1-261 | 2308 | QNIATY | | HTS | 2571 | SSWAGSRSGTV |
| DKK1-262 | 2309 | GDLRNKY | | GQH | 2572 | SSGSRSGTV |
| DKK1-263 | 2310 | QPIGPD | | ANT | 2573 | QQSYSAPYT |
| DKK1-264 | 2311 | QSIYSF | | RKS | 2574 | QQTATWPFT |
| DKK1-265 | 2312 | QDINKY | | DNT | 2575 | QQSYSTPT |
| DKK1-266 | 2313 | DHIGKF | | HTS | 2576 | QQSYKYPLT |
| DKK1-267 | 2314 | HNINSY | | QDF | 2577 | QQSYSSPLT |
| DKK1-268 | 2315 | QDINKY | | DNT | 2578 | QQSYSTPT |
| DKK1-269 | 2316 | QDISNY | | GTS | 2579 | QQGYTLPWT |
| DKK1-270 | 2317 | QNIGNF | | HTS | 2580 | QQSYSAPLT |
| DKK1-271 | 2318 | SSVTY | | HDN | 2581 | QQSYDNPLT |
| DKK1-272 | 2319 | QDIYQN | | QND | 2582 | LQFDHTPFT |
| DKK1-273 | 2320 | QDIGNY | | HTS | 2583 | QQGYRFPLT |
| DKK1-274 | 2321 | QPIAYF | | GKN | 2584 | ASRSSKGNPHVL |
| DKK1-275 | 2322 | DNLRGYY | | QDF | 2585 | QQSYSPLT |
| DKK1-276 | 2323 | QLVHSTGNTY | | GAS | 2586 | SQSTHVPT |
| DKK1-277 | 2324 | SLRNYY | | ENN | 2587 | STRSRKGNPHVL |
| DKK1-278 | 2325 | QDIKNY | | QAS | 2588 | QQSYSPPLT |
| DKK1-279 | 2326 | QDVSSG | | DDI | 2589 | HQRSSYPWT |
| DKK1-280 | 2327 | QGVRTS | | SAS | 2590 | QAWDNSAVI |
| DKK1-281 | 2328 | QDINKY | | DNT | 2591 | QQSYSTPT |
| DKK1-282 | 2329 | KLAEKN | | QND | 2592 | QQTYSTPLT |
| DKK1-283 | 2330 | QTIGDY | | AAS | 2593 | QQSNSWPYT |
| DKK1-284 | 2331 | QSISSY | | LSS | 2594 | AQTGTHPTT |
| DKK1-285 | 2332 | QSLSSY | | EDT | 2595 | HTWHHNPHTGETNH |
| DKK1-286 | 2333 | QDINKY | | DNT | 2596 | QQSYSTPT |
| DKK1-287 | 2334 | QDVSSG | | GAS | 2597 | NSRDTSGLHYV |
| DKK1-288 | 2335 | QTIERR | | ENN | 2598 | QQTYSPPLT |
| DKK1-289 | 2336 | QDINKY | | GAS | 2599 | QQSYSSPLT |
| DKK1-290 | 2337 | QSIRSF | | GQH | 2600 | QQYYDWPLT |
| DKK1-291 | 2338 | QDIYQN | | GKN | 2601 | QQYYSGWT |
| DKK1-292 | 2339 | QSLSSY | | GRN | 2602 | QNVLSTPYT |
| DKK1-293 | 2340 | GDLRNKY | | GTS | 2603 | QAWVSSTVV |
| DKK1-294 | 2341 | QSVDRY | | SAS | 2604 | SQSTHVPLT |
| DKK1-295 | 2342 | QFIGRY | | GRN | 2605 | QQSYSTPT |
| DKK1-296 | 2343 | QPIGPD | | GKK | 2606 | QQSYSTPRT |
| DKK1-297 | 2344 | QTIGDY | | GAS | 2607 | SQSTHVPT |
| DKK1-298 | 2345 | QTIERR | | GQH | 2608 | QQYHSYPPT |
| DKK1-299 | 2346 | QSIRRF | | GAS | 2609 | QQSFSVPA |
| DKK1-300 | 2347 | QDIYQN | | GNN | 2610 | QQSYSAPLT |
| DKK1-301 | 2348 | QNIATY | | HDN | 2611 | LQDYNYPLT |
| DKK1-302 | 2349 | QDINKY | | GRN | 2612 | QQTYNVPPT |
| DKK1-303 | 2350 | QNIGNF | | NAK | 2613 | ASRDRSGHGV |
| DKK1-304 | 2351 | QTIERR | | QND | 2614 | SSRDRSGNHRV |
| DKK1-305 | 2352 | QRISSF | | QND | 2615 | QQSYSTPT |
| DKK1-306 | 2353 | QSISSY | | HDN | 2616 | AQNLEIPRT |
| DKK1-307 | 2354 | DKLGDKY | | HDN | 2617 | QPSFYFPYT |
| DKK1-308 | 2355 | QDIYQN | | GKN | 2618 | QQYYSGWT |
| DKK1-309 | 2356 | QSISSY | | GAS | 2619 | QQYWAFPVT |
| DKK1-310 | 2357 | QSISGY | | AKN | 2620 | QQSYSSPRT |
| DKK1-311 | 2358 | QDINKY | | DTS | 2621 | QQSYSTPNT |
| DKK1-312 | 2359 | QNIRSY | | DNN | 2622 | LQDYNLWT |
| DKK1-313 | 2360 | QSIREY | | ATS | 2623 | QAWDTSTAV |
| DKK1-314 | 2361 | GDLGEKY | | ATS | 2624 | QAWASSTVV |
| DKK1-315 | 2362 | QNIATY | | GNN | 2625 | STRSSKGNPHVL |
| DKK1-316 | 2363 | KVSTGYVY | | ENN | 2626 | QQYWAFPVT |
| DKK1-317 | 2364 | SSVSY | | GEN | 2627 | QQSYSTPWT |
| DKK1-318 | 2365 | QDVSSG | | GS | 2628 | QQYHSYPPT |
| DKK1-319 | 2366 | QSVDRY | | HTS | 2629 | QAWDNRAVV |

TABLE 8-continued

Variable Light Chain CDRs

| DKK1 Variant | SEQ ID NO | CDR1 Sequence | CDR2 Sequence | SEQ ID NO | CDR3 Sequence |
|---|---|---|---|---|---|
| DKK1-320 | 2367 | QSVYSNNE | GNN | 2630 | QQSYSTPT |
| DKK1-321 | 2368 | QSISTY | AAS | 2631 | QQNYIIPWT |
| DKK1-322 | 2369 | HSISSY | TAS | 2632 | QQNYNTPFT |
| DKK1-323 | 2370 | QSIHSY | TAS | 2633 | QQSFSSPLT |
| DKK1-324 | 2371 | QSVSRF | AAA | 2634 | QQSYDTPFT |
| DKK1-325 | 2372 | QSIGTY | DAS | 2635 | QQNYNTPLT |
| DKK1-326 | 2373 | QSIGIH | GAT | 2636 | QQSYNTPPYT |
| DKK1-327 | 2374 | QSIRSY | ATS | 2637 | QQGYTSPLT |
| DKK1-328 | 2375 | QGIATY | GAS | 2638 | QQTFNTPLT |
| DKK1-329 | 2376 | QSIGSY | AAS | 2639 | QQSHNIPRT |
| DKK1-330 | 2377 | QSISRN | GAS | 2640 | QQGYITPQT |
| DKK1-331 | 2378 | QSVRTY | RAS | 2641 | QQSFTTPLT |
| DKK1-332 | 2379 | QSIGSH | RAS | 2642 | QQSYSPPIT |
| DKK1-333 | 2380 | QSISRY | GAS | 2643 | QQSSSVPWT |
| DKK1-334 | 2381 | QNIGNY | AAS | 2644 | QQNYNTPLT |
| DKK1-335 | 2382 | QSISTY | AAS | 2645 | QQSYTPPIT |
| DKK1-336 | 2383 | QNIGSY | AAS | 2646 | QQSYNTPVT |
| DKK1-337 | 2384 | QSISRF | GAS | 2647 | QQSYIPPLT |
| DKK1-338 | 2385 | ESITTY | TAS | 2648 | QQNYITPLT |
| DKK1-339 | 2386 | QSISTY | AAS | 2649 | QQSYNSIT |
| DKK1-340 | 2387 | QSIGSN | ATS | 2650 | QQSYRIPRT |
| DKK1-341 | 2388 | QSISRY | AAS | 2651 | QQSYSTPTT |
| DKK1-342 | 2389 | QYIGTY | AAS | 2652 | QQSYSDLT |
| DKK1-343 | 2390 | ESISRN | AAS | 2653 | QQSYSGPPYT |
| DKK1-344 | 2391 | QSISTY | AAS | 2654 | QQNYIIPWT |
| DKK1-345 | 2392 | QSVSNF | GAS | 2655 | QQSYSFPFS |
| DKK1-346 | 2393 | RNIRTY | RAS | 2656 | QQSYKTPVT |
| DKK1-347 | 2394 | QSIGNF | RAS | 2657 | QQSYNTPIT |
| DKK1-348 | 2395 | QSIRSY | GAT | 2658 | QQSYSTLPFT |
| DKK1-349 | 2396 | QSIRTY | GAV | 2659 | QQRDT |
| DKK1-350 | 2397 | QNIYTY | LAS | 2660 | QQSYSTRFT |
| DKK1-351 | 2398 | QSISRY | GSS | 2661 | QQSYSSPT |
| DKK1-352 | 2399 | QNIGRY | SAS | 2662 | QQTYSPPLT |
| DKK1-353 | 2400 | QTISAY | GAS | 2663 | QQSYSGLT |
| DKK1-354 | 2401 | QSIRGY | STS | 2664 | QQNYNTPLT |
| DKK1-355 | 2402 | QSVSYY | GSS | 2665 | QQTYSSPVT |
| DKK1-356 | 2403 | QPISSY | SAS | 2666 | QQGYSAPLT |
| DKK1-357 | 2404 | QSIGKY | GAS | 2667 | QQTYSTPLT |
| DKK1-358 | 2405 | QSIGAY | GTS | 2668 | QQSYGTLIT |
| DKK1-359 | 2406 | QTISTF | GAS | 2669 | QQSYSTPLT |
| DKK1-360 | 2407 | QSIGRY | AVS | 2670 | QQSYSTPS |
| DKK1-361 | 2408 | QSISNY | GAS | 2671 | QQSYSLPLT |
| DKK1-362 | 2409 | QTISRS | GAS | 2672 | QQSFTTPYT |
| DKK1-363 | 2410 | QSISSY | AAS | 2673 | QQNYRSPLT |
| DKK1-364 | 2411 | RSIGTY | AAS | 2674 | QQNYITPLT |
| DKK1-365 | 2412 | QNINRY | ASS | 2675 | QQSYSSPIT |
| DKK1-366 | 2413 | QSVSSY | ATS | 2676 | HQTYSTPRT |
| DKK1-367 | 2414 | QSIGIH | GAT | 2677 | QQSYNTPPYT |
| DKK1-368 | 2415 | RSISTY | EVS | 2678 | QQNYITPLT |
| DKK1-369 | 2416 | QSISRY | AAS | 2679 | QQGYSSPLT |
| DKK1-370 | 2417 | QSISNF | GTS | 2680 | QQSYSIPFT |
| DKK1-371 | 2418 | QGISFY | AAS | 2681 | QQSYSTPQIT |
| DKK1-372 | 2419 | QNIKTY | GAS | 2682 | LQTYSVPLT |
| DKK1-373 | 2420 | QYISNY | GAS | 2683 | QQTYSLPLT |
| DKK1-374 | 2421 | QTISTF | GAS | 2684 | QQSYSTPLT |
| DKK1-375 | 2422 | QSISRF | GAS | 2685 | QQSYKTPRT |
| DKK1-376 | 2423 | ESIDNY | GAT | 2686 | QQNYNIPFT |
| DKK1-377 | 2424 | QSISNF | TAS | 2687 | QQSYRVPRT |
| DKK1-378 | 2425 | QSIGTN | AAS | 2688 | QQSYSIPLT |
| DKK1-379 | 2426 | QTITRY | AAT | 2689 | QQSYSTPET |
| DKK1-380 | 2427 | QSIGNF | DAS | 2690 | QQSYSIPPT |
| DKK1-381 | 2428 | HSISRY | GAS | 2691 | QQSYSTHT |
| DKK1-382 | 2429 | QGISFY | GAS | 2692 | QQSYSPPLT |
| DKK1-383 | 2430 | QSVSNY | GAS | 2693 | QQSYVTPPT |
| DKK1-384 | 2431 | QSIGSF | AAF | 2694 | QQTYSPPFT |
| DKK1-385 | 2432 | QSITRH | AAS | 2695 | QQSYSTPGT |
| DKK1-386 | 2433 | QRISRY | GAS | 2696 | QQSYRTPIT |
| DKK1-387 | 2434 | QYIGNY | AVS | 2697 | QQSFSAPYT |
| DKK1-388 | 2435 | QYISTF | SAS | 2698 | QQSYSPLT |
| DKK1-389 | 2436 | RSISRY | GAS | 2699 | QQSYTPPRT |
| DKK1-390 | 2437 | QSISRS | GAS | 2700 | QQSFTIPWT |
| DKK1-391 | 2438 | QSITSY | AAS | 2701 | QQSYNTPVT |
| DKK1-392 | 2439 | QNIAGY | AAS | 2702 | QQSSSTPIT |
| DKK1-393 | 2440 | QTIRTY | ATS | 2703 | QQSYRPPLT |

TABLE 8-continued

Variable Light Chain CDRs

| DKK1 Variant | SEQ ID NO | CDR1 Sequence | SEQ ID NO | CDR2 Sequence | SEQ ID NO | CDR3 Sequence |
|---|---|---|---|---|---|---|
| DKK1-394 | 2441 | QSIGIH | | GAT | 2704 | QQSYNTPPYT |
| DKK1-395 | 2442 | QSISTY | | GAS | 2705 | QQTYSAPRT |
| DKK1-396 | 2443 | QSIGRY | | GAS | 2706 | QQSYRTPLT |
| DKK1-397 | 2444 | HTISRY | | AAS | 2707 | QQSFTAPDT |
| DKK1-398 | 2445 | QSISRY | | TTS | 2708 | QQSYSDLT |
| DKK1-399 | 2446 | QRINTY | | GAF | 2709 | QQSYRVPRT |
| DKK1-400 | 2447 | QSINHY | | GAS | 2710 | QQSYSLPRT |
| DKK1-401 | 2448 | QTIGRY | | ATS | 2711 | QQTYSTPYT |
| DKK1-402 | 2449 | QSIGEY | | AAS | 2712 | QQNYRSPLT |
| DKK1-403 | 2450 | QSIYRY | | AAT | 2713 | QQSYSPPLT |
| DKK1-404 | 2451 | QNIGRY | | EVS | 2714 | QQSYRTPGT |
| DKK1-405 | 2452 | QSIRNY | | AAT | 2715 | QQSFLTPWT |
| DKK1-406 | 2453 | QSISRH | | GAT | 2716 | QQSYSKPYT |
| DKK1-407 | 2454 | QSISRY | | AAT | 2717 | QQSYSTPLS |
| DKK1-408 | 2455 | QSIGTY | | DTS | 2718 | QQSFTSPLT |
| DKK1-409 | 2456 | QGIATY | | AAS | 2719 | QQTHSTPLT |
| DKK1-410 | 2457 | QNIGGY | | RAS | 2720 | QQSYSTPLLT |
| DKK1-411 | 2458 | QYIGNY | | ASS | 2721 | QQTSSTPLT |
| DKK1-412 | 2459 | QSIGTY | | DAS | 2722 | QQNYNTPLT |
| DKK1-413 | 2460 | QNIGRY | | AAS | 2723 | QQSYTPPRT |
| DKK1-414 | 2461 | QSISRH | | GAS | 2724 | QQTYRTPLT |
| DKK1-415 | 2462 | QSIHNY | | AAS | 2725 | QQSYSTPYT |
| DKK1-416 | 2463 | QGIATY | | GAS | 2726 | QQTFTNTPLT |
| DKK1-417 | 2464 | QTITKY | | ATS | 2727 | QQSYSAPVT |

Example 5: DKK1 Variants

In this experiment, the antibodies were tested for their yield, SPR affinity, and enrichment from eluted phage (Tables 9-10).

Figure 10A:
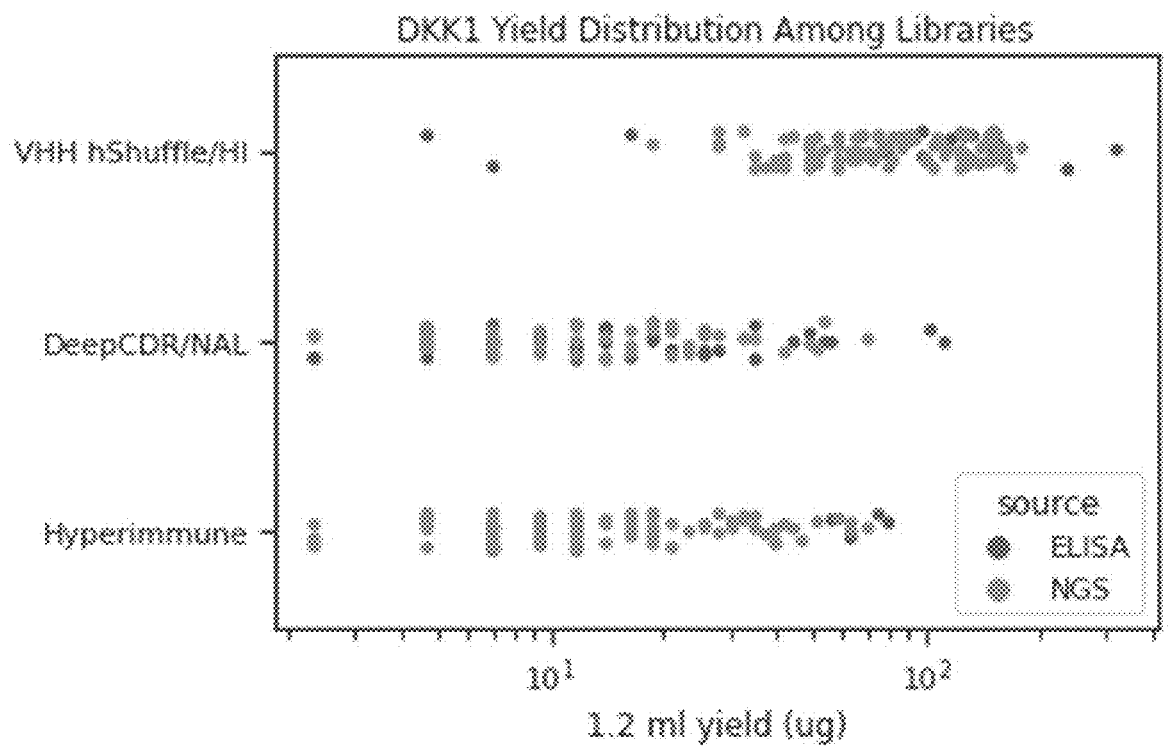
FIG. 10A depicts the distribution of antibody yields from 1.2 mL high-throughput antibody expression and purification among antibodies identified from the three library pools. Points are color-coded by whether the antibody was identified by phage ELISA screening (blue) or NGS enrichment data (green).
Figure 10B:
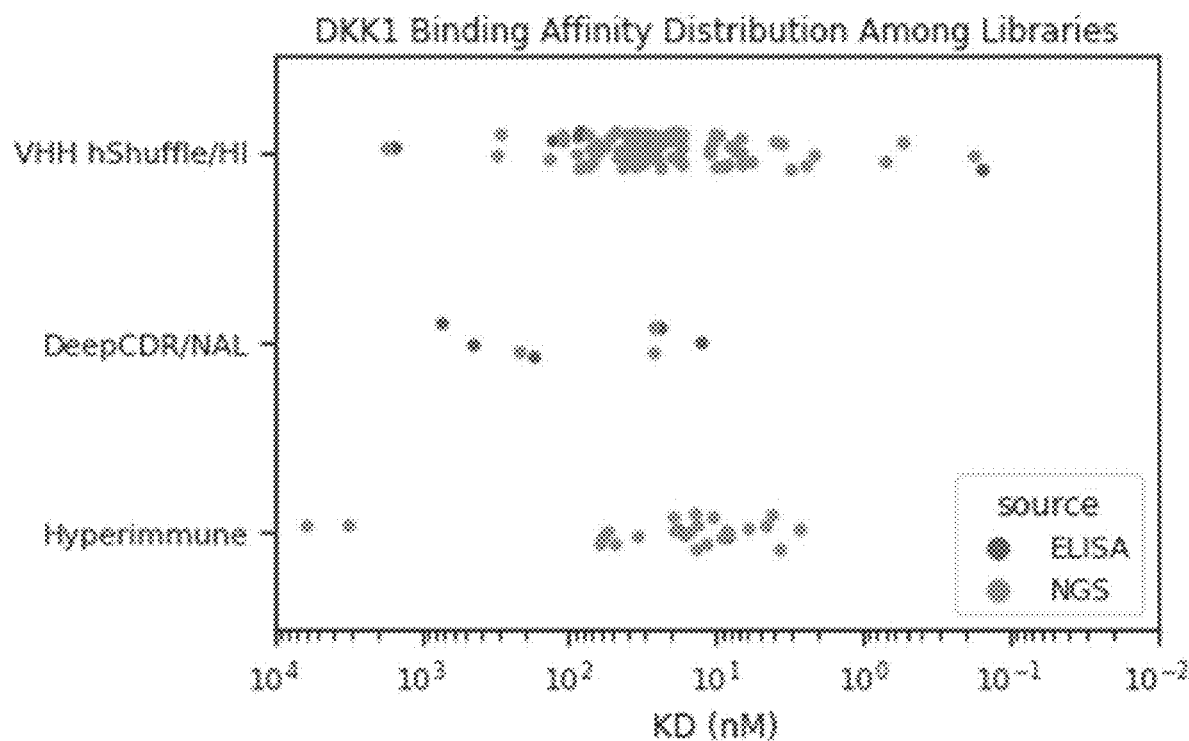
FIG. 10B depicts the distribution of antibody binding affinity to DKK1 as measured by SPR (Carterra). Points are color-coded by whether the antibody was identified by phage ELISA screening (blue) or NGS enrichment data (green).
Figure 10C:
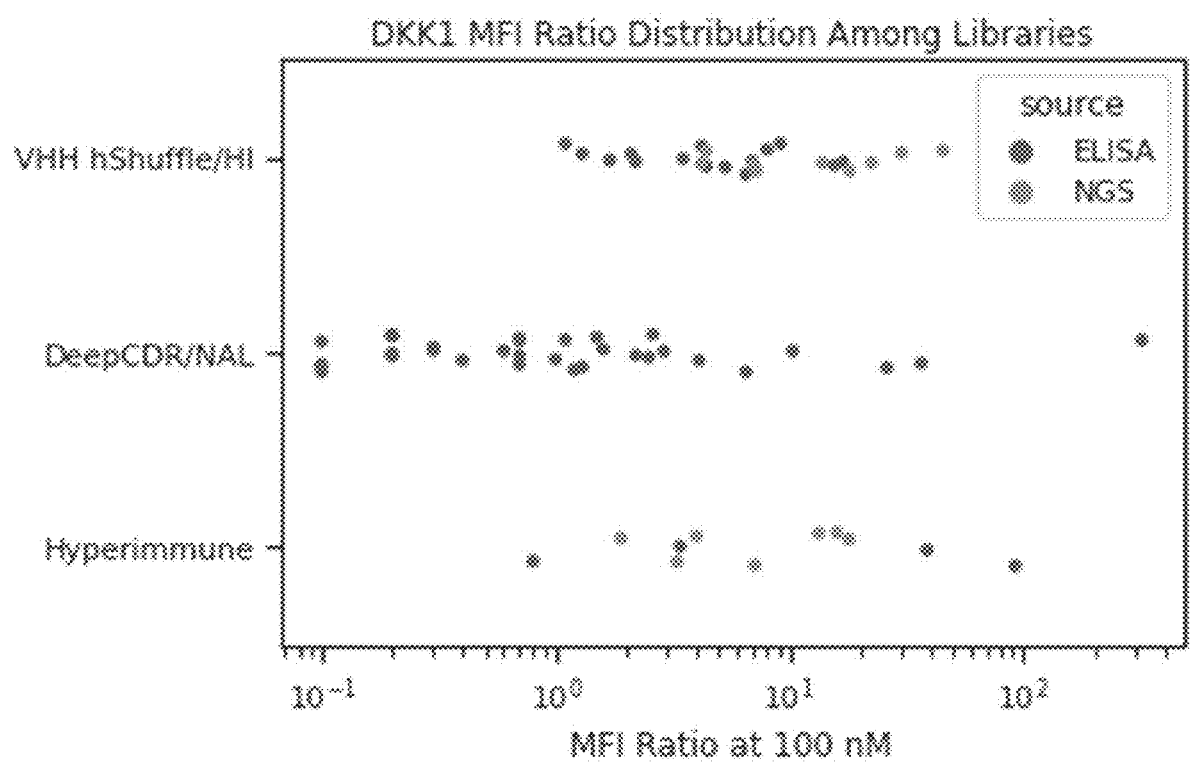
FIG. 10C depicts the distribution of MFI ratio among antibodies identified from the three library pools. The MFI ratio is defined as the MFI measured of the antibody binding to HEK293 cells overexpressing DKK1 divided by the MFI measured of the antibody binding to HEK293 cells. Points are color-coded by whether the antibody was identified by phage ELISA screening (blue) or NGS enrichment data (green).
Figure 11A:
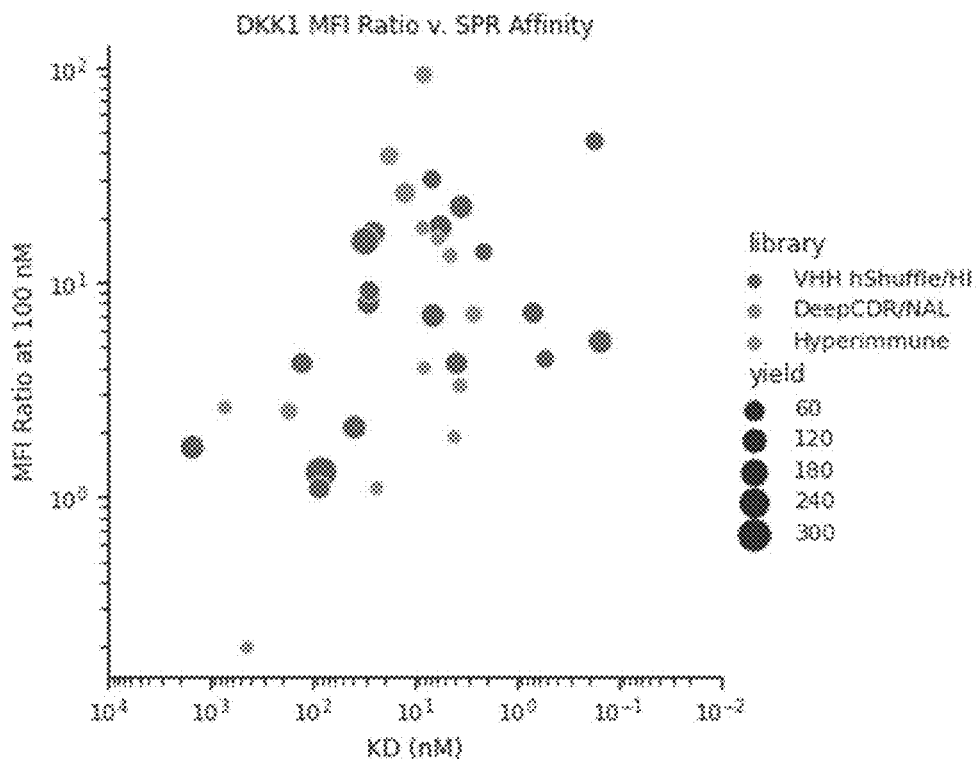
FIG. 11A depicts the relationship between the MFI ratio and binding affinity to DKK1 as measured by SPR. The size of each dot corresponds to the antibody yield from 1.2 ml high-throughput antibody expression and purification. Points are color-coded by the library pool used during panning.
Figure 11B:
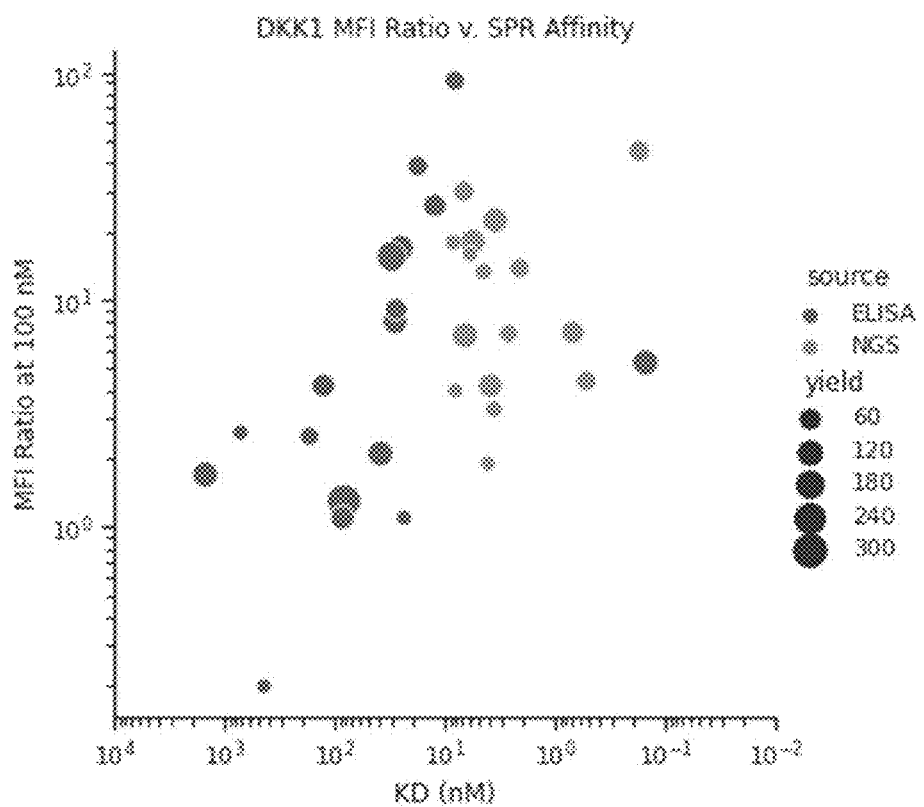
FIG. 11B depicts the relationship between the MFI ratio and binding affinity to DKK1 as measured by SPR. The size of each dot corresponds to the antibody yield from 1.2 ml high-throughput antibody expression and purification. Points are color-coded by whether the antibody was identified by phage ELISA screening (blue) or NGS enrichment data (green).
Figure 12A:
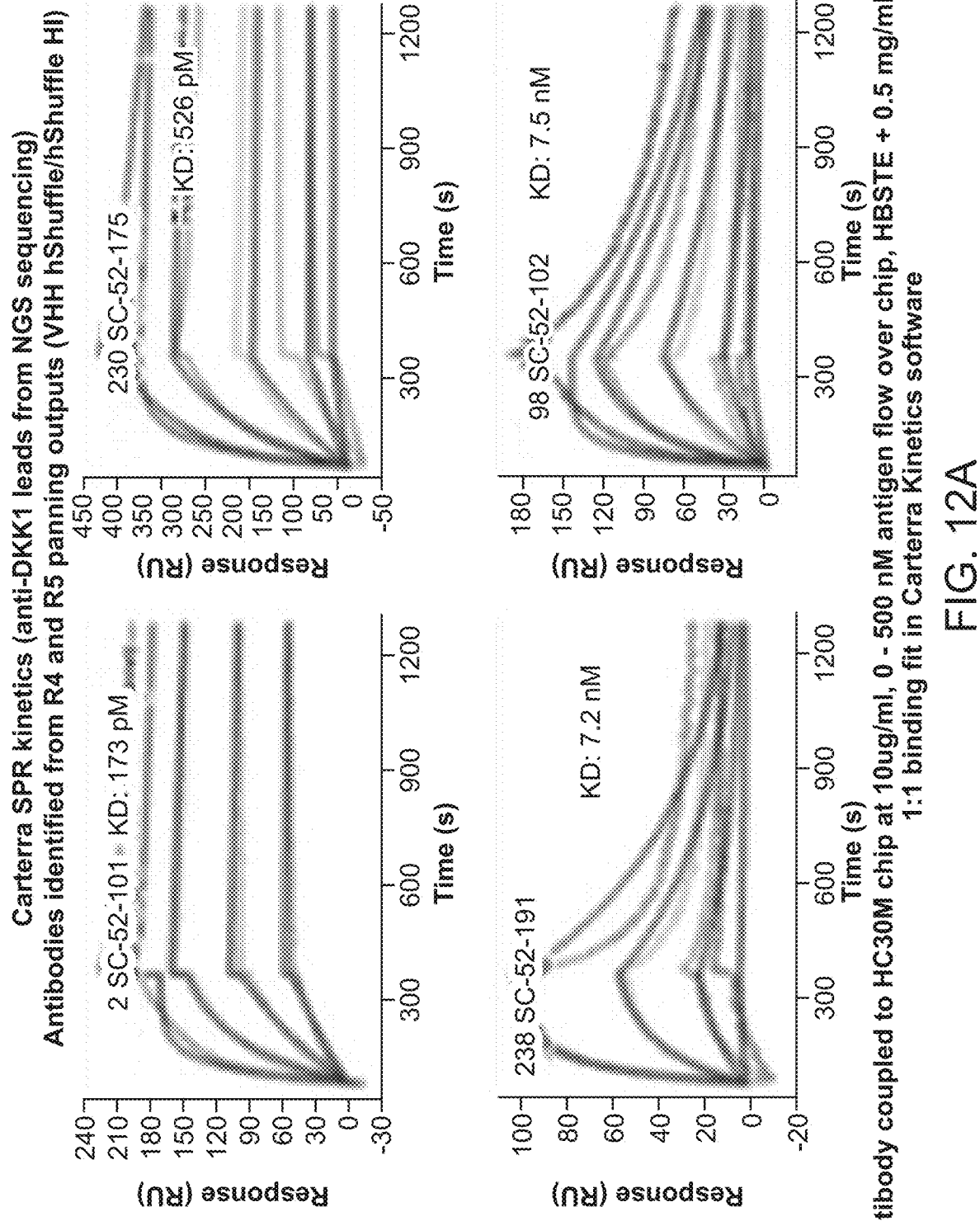
FIG. 12A depicts Carterra SPR kinetic graphs showing VHH-Fc hits identified from NGS sequencing binding with high affinity to DKK1. Antibody lawn (10 ug/mL), 0-500 nM antigen, HBSTE+0.5 mg/mL BSA pH 7.4.
Figure 12A:
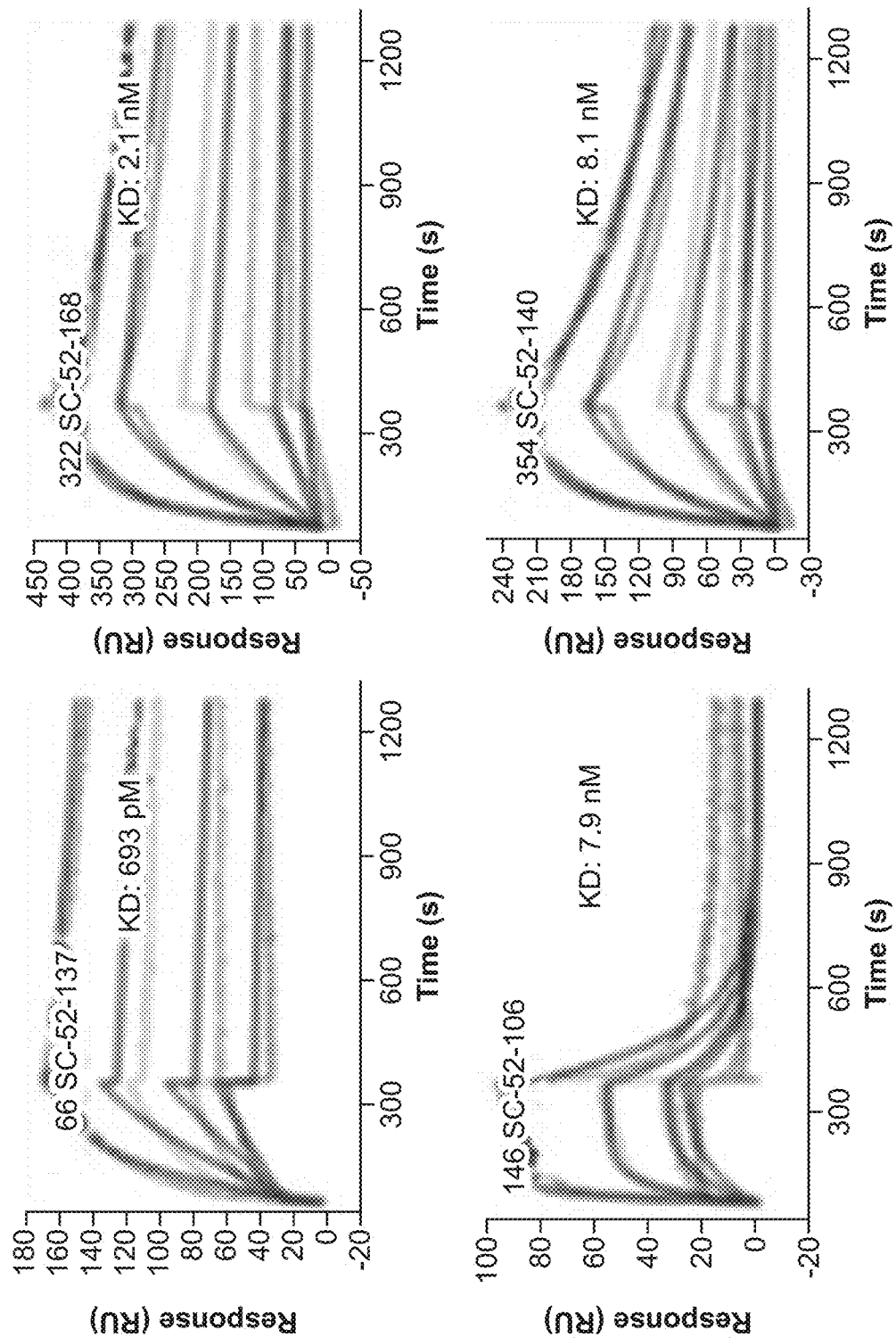
Figure 12A:
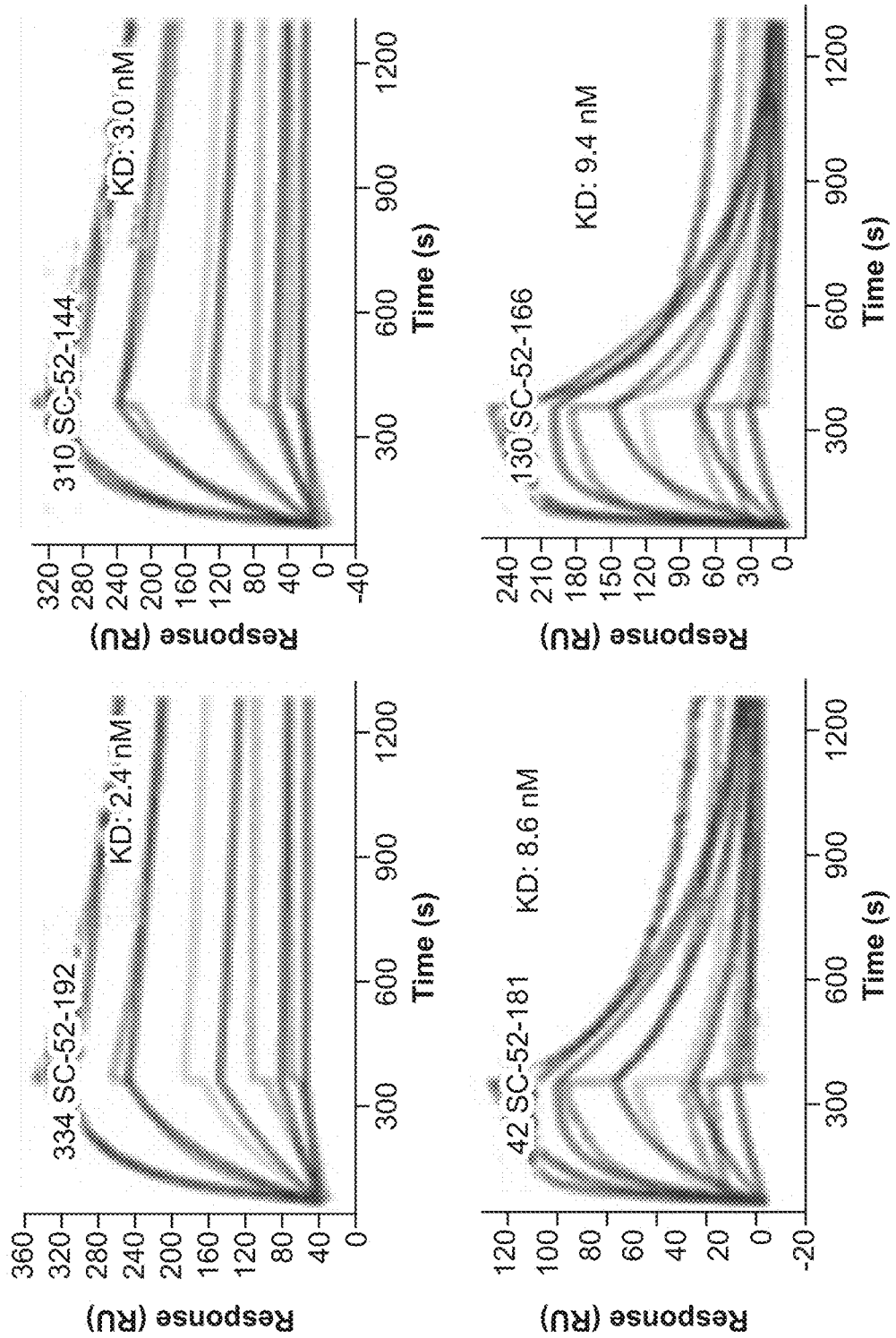
Figure 12A:
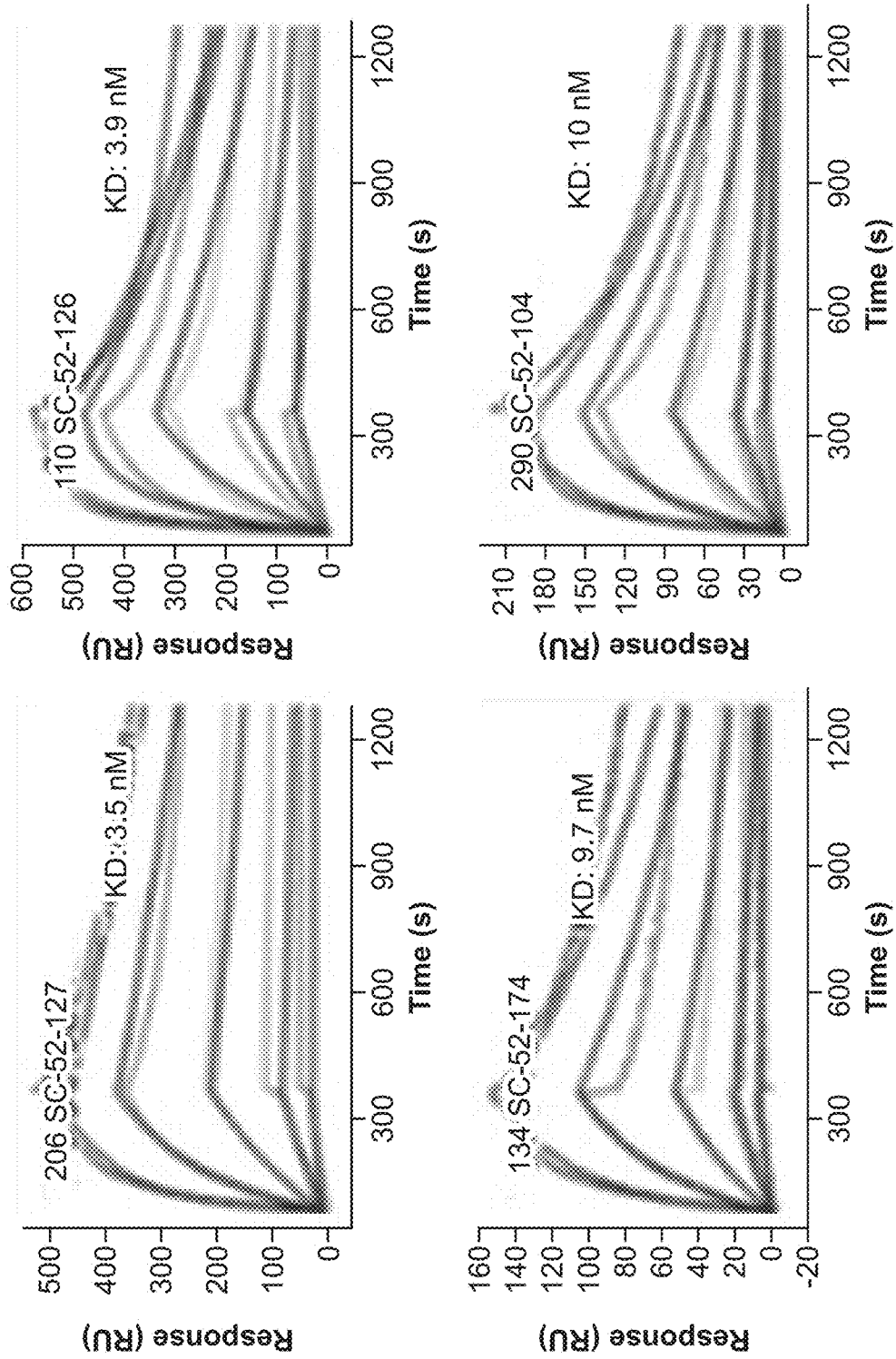
Figure 12A:
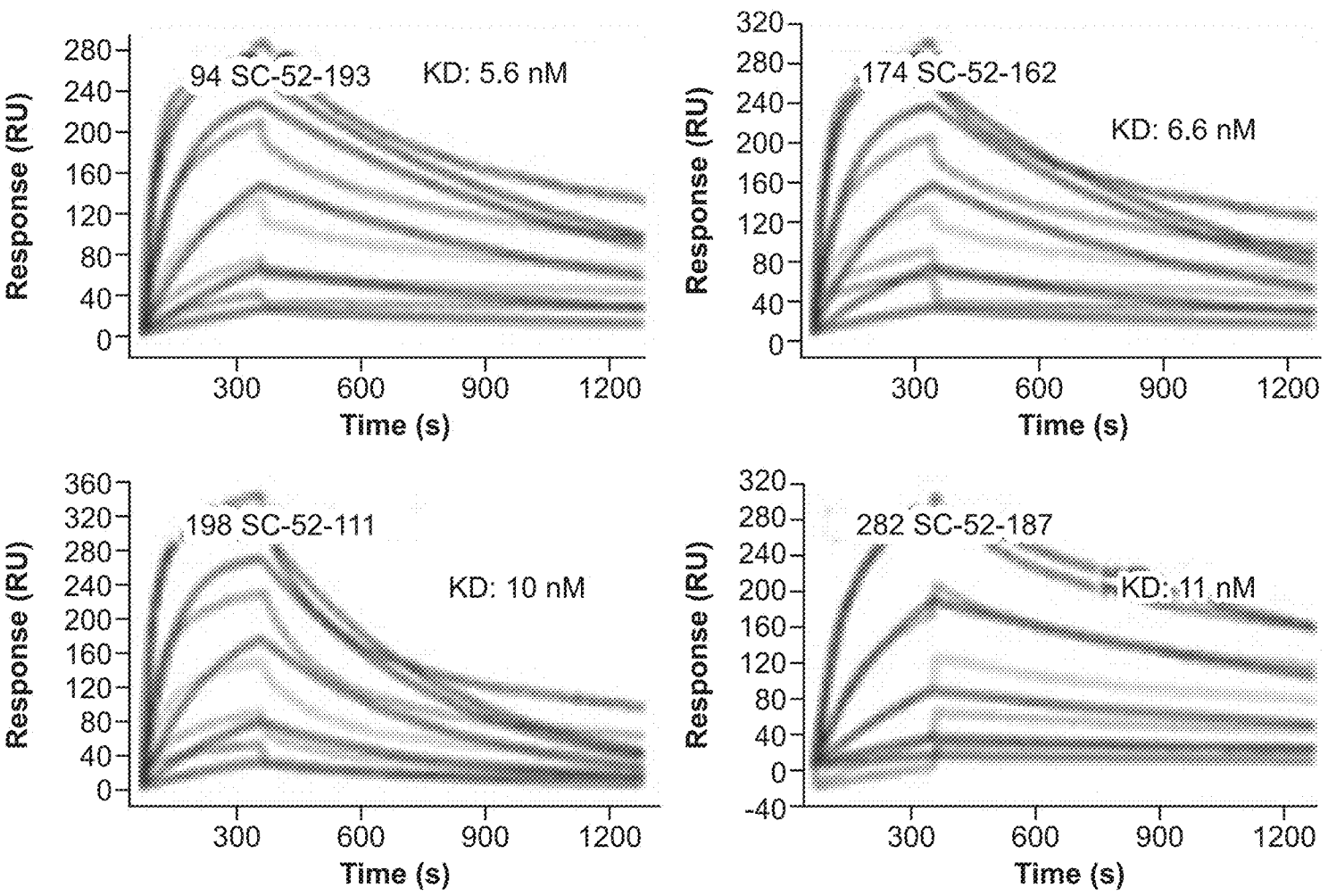
Figure 12A:
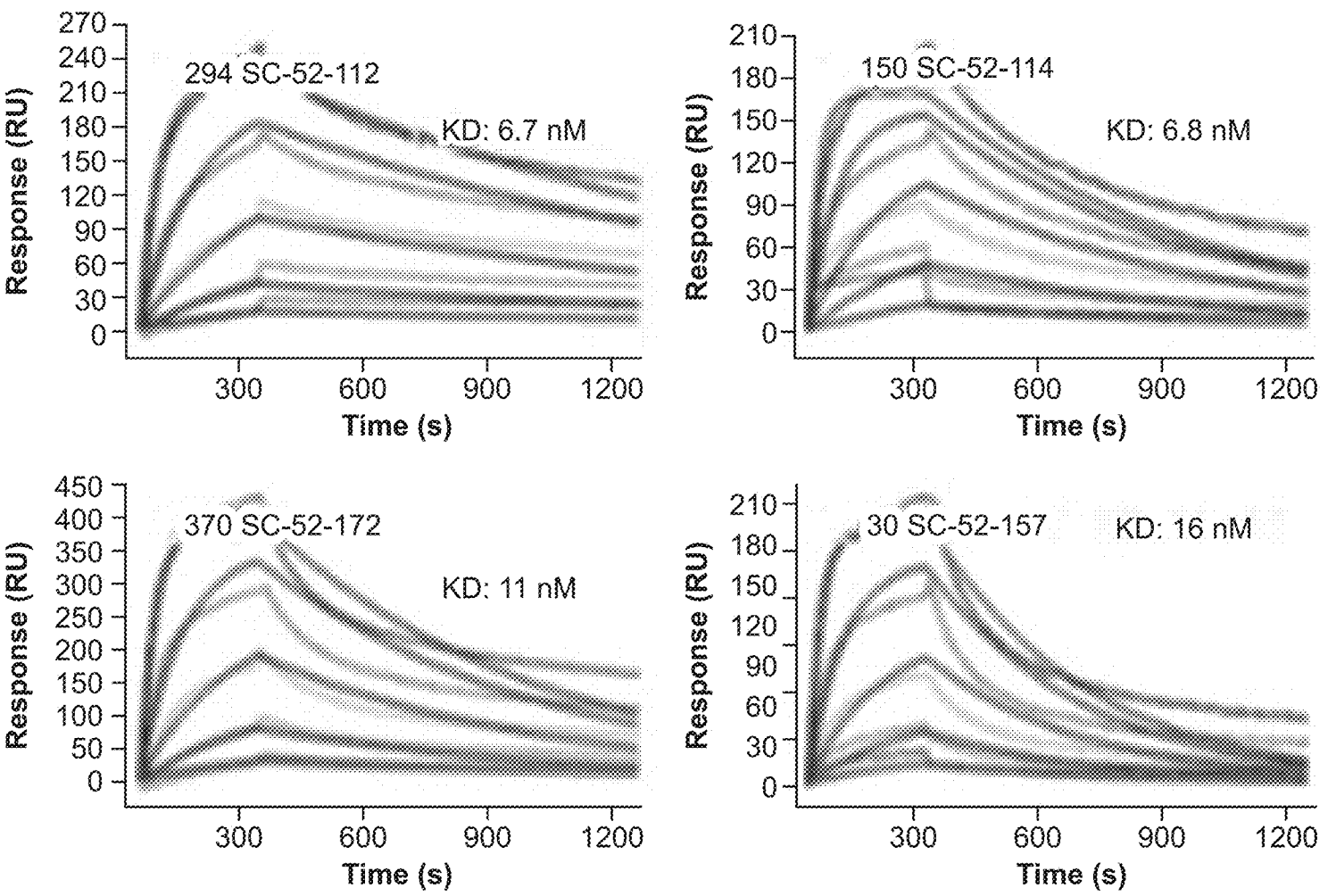
Figure 12A:
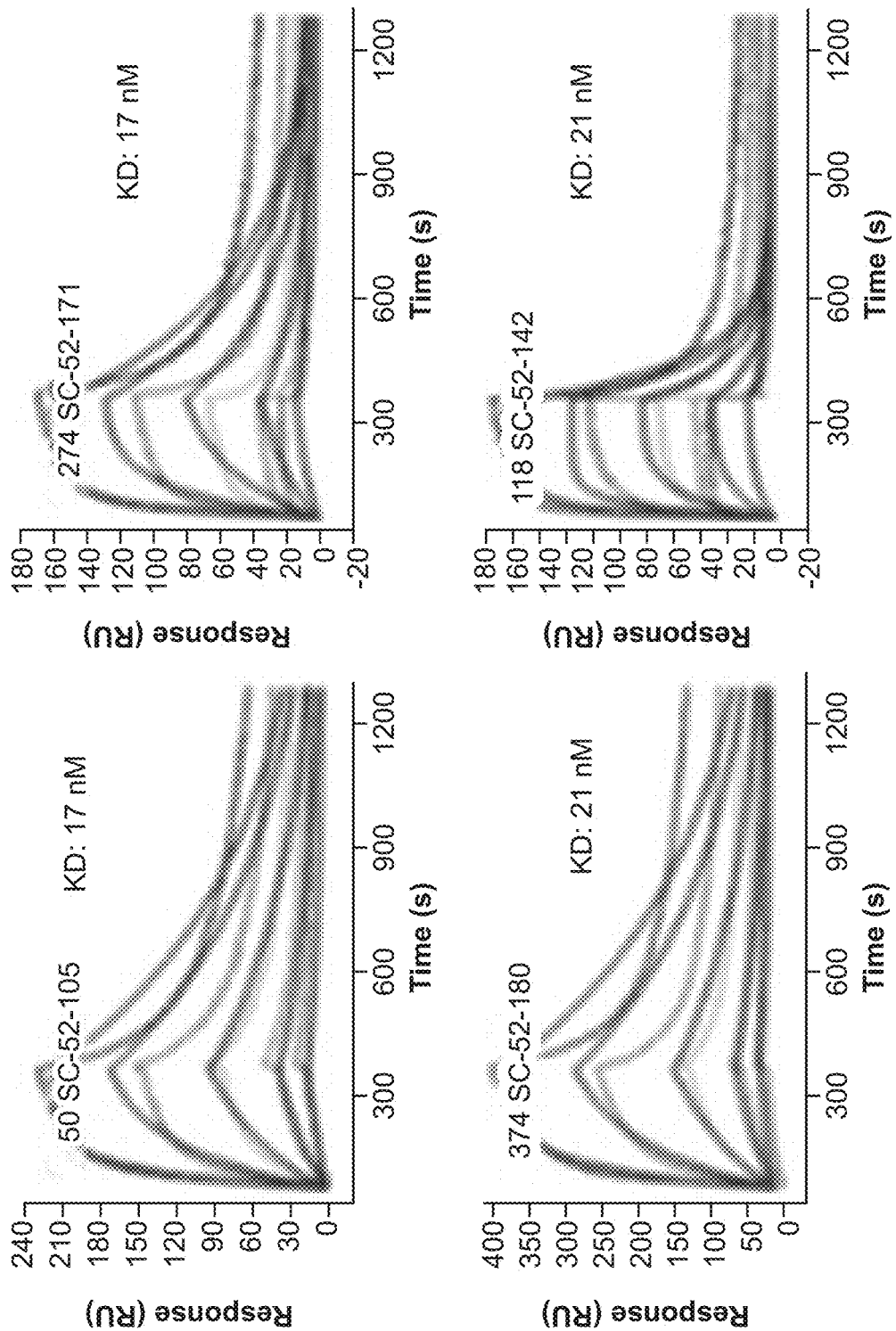
Figure 12A:
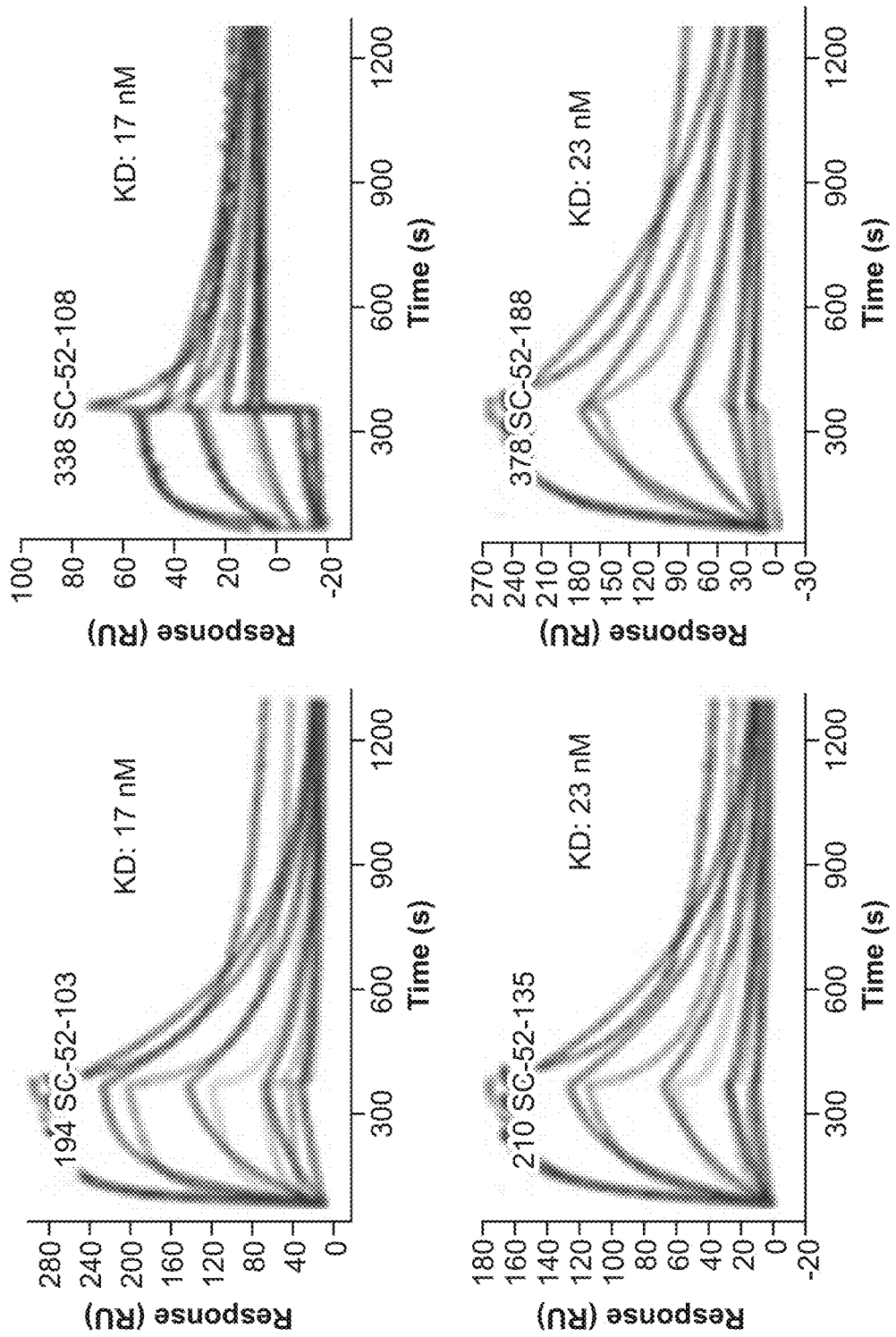
Figure 12A:
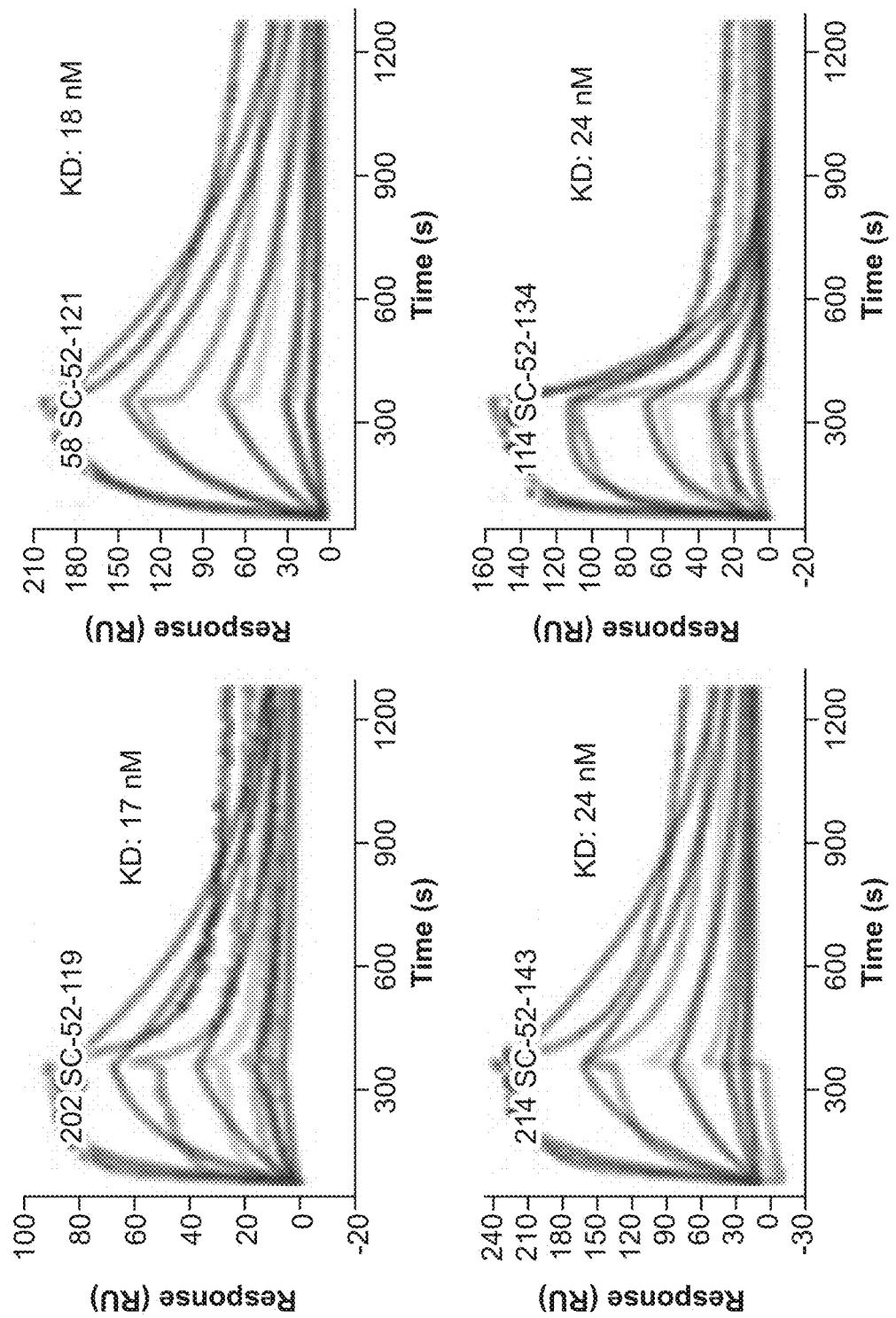
Figure 12A:
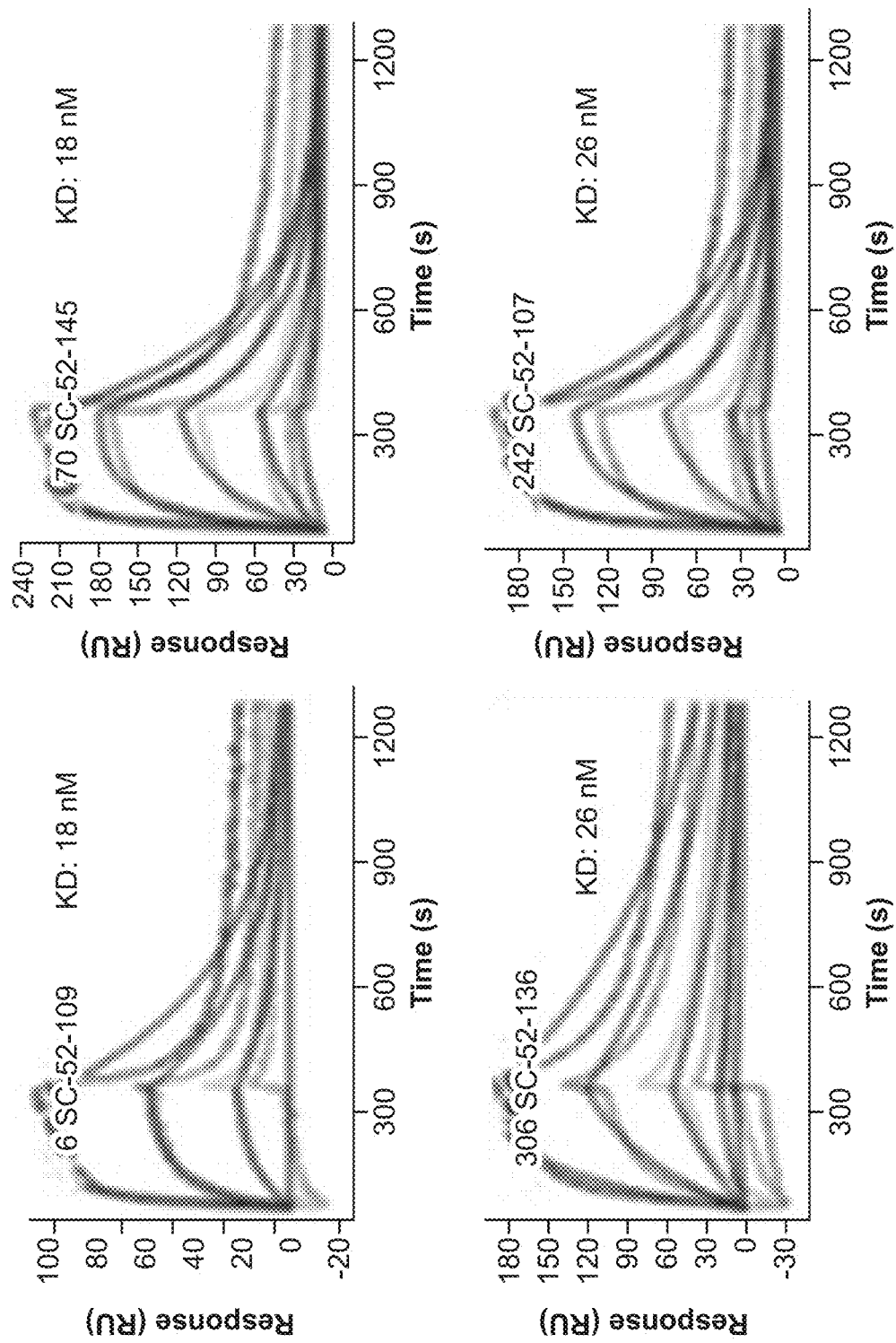
Figure 12A:
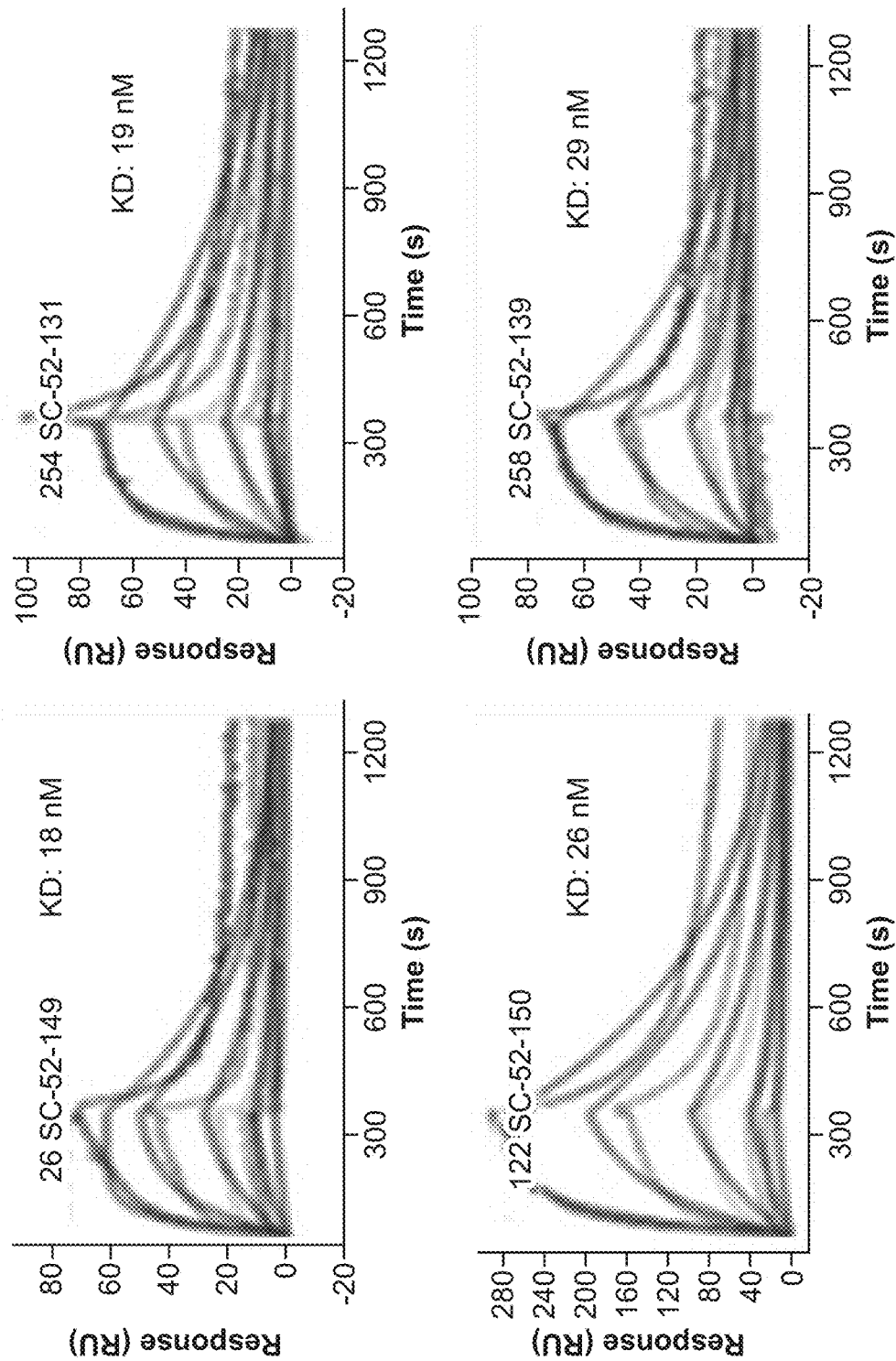
Figure 12A:
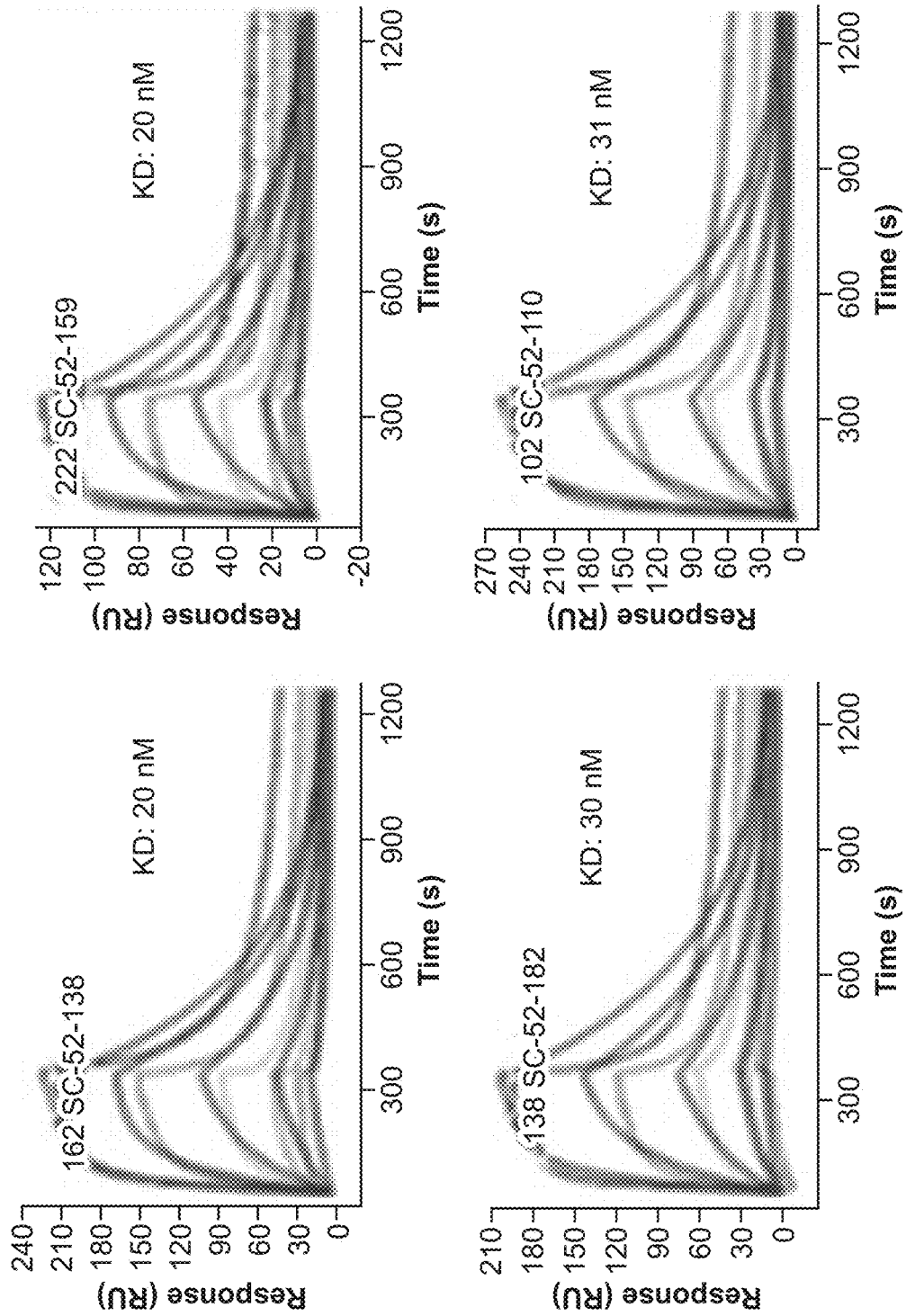
Figure 12A:
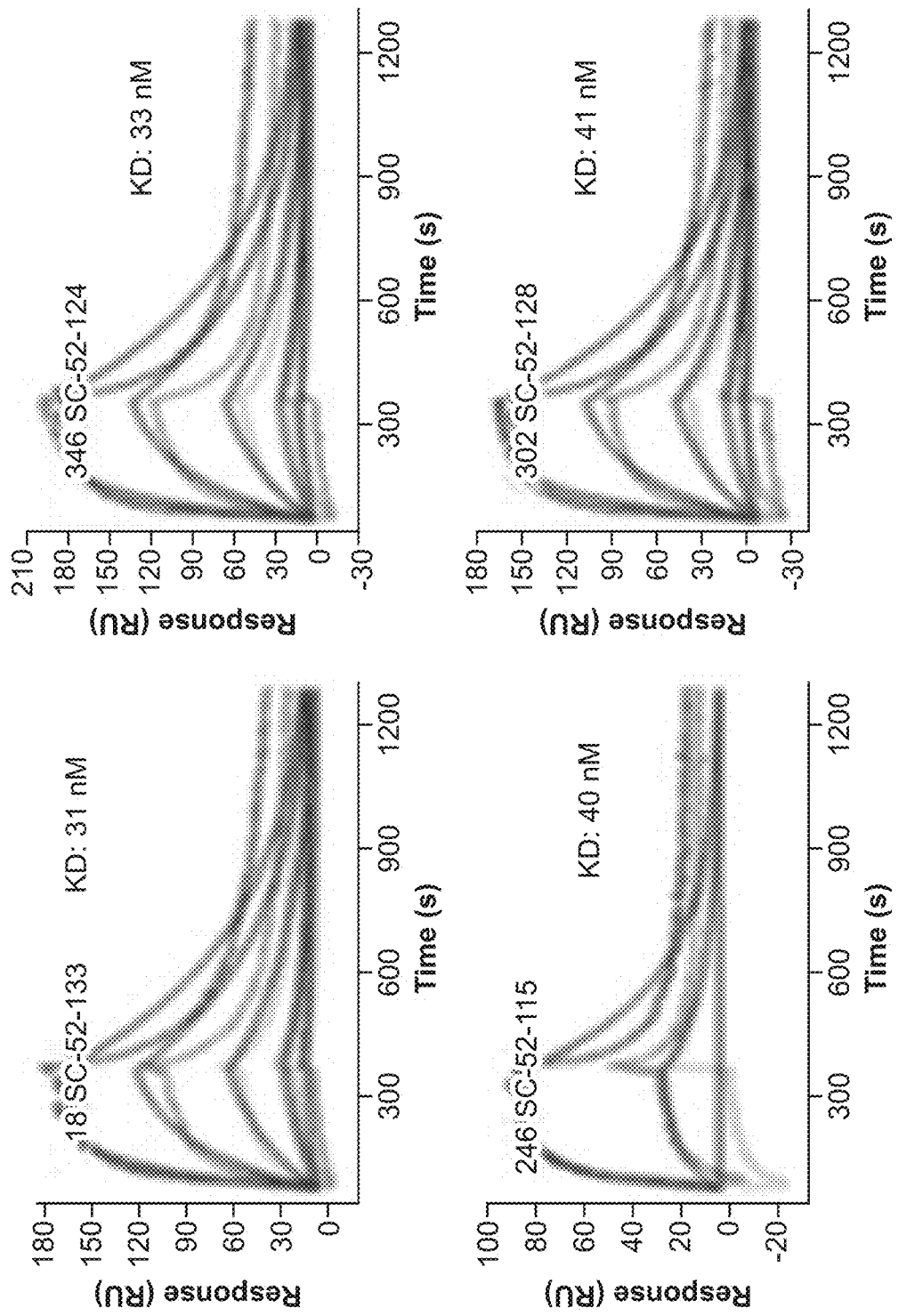
Figure 12A:
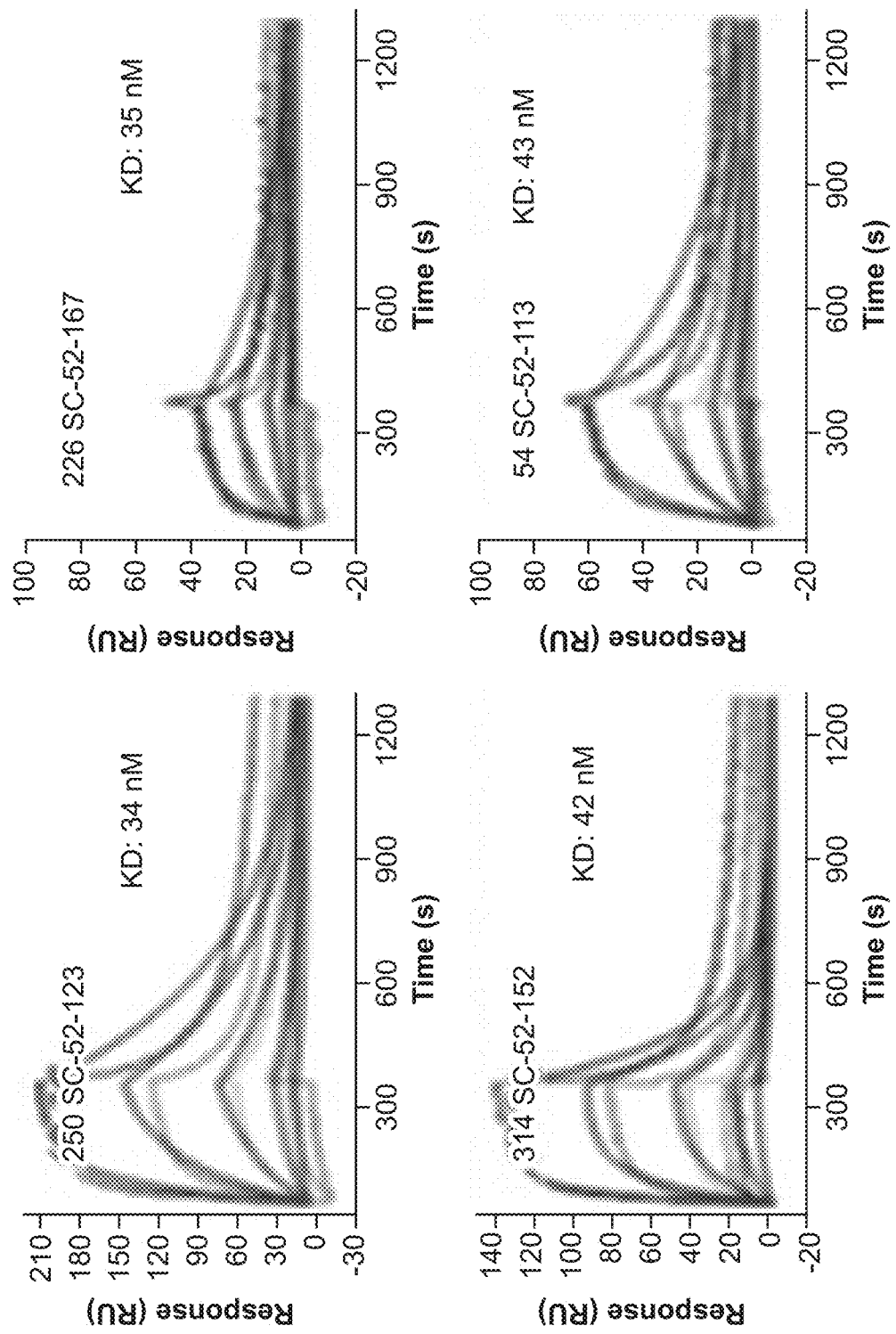
Figure 12A:
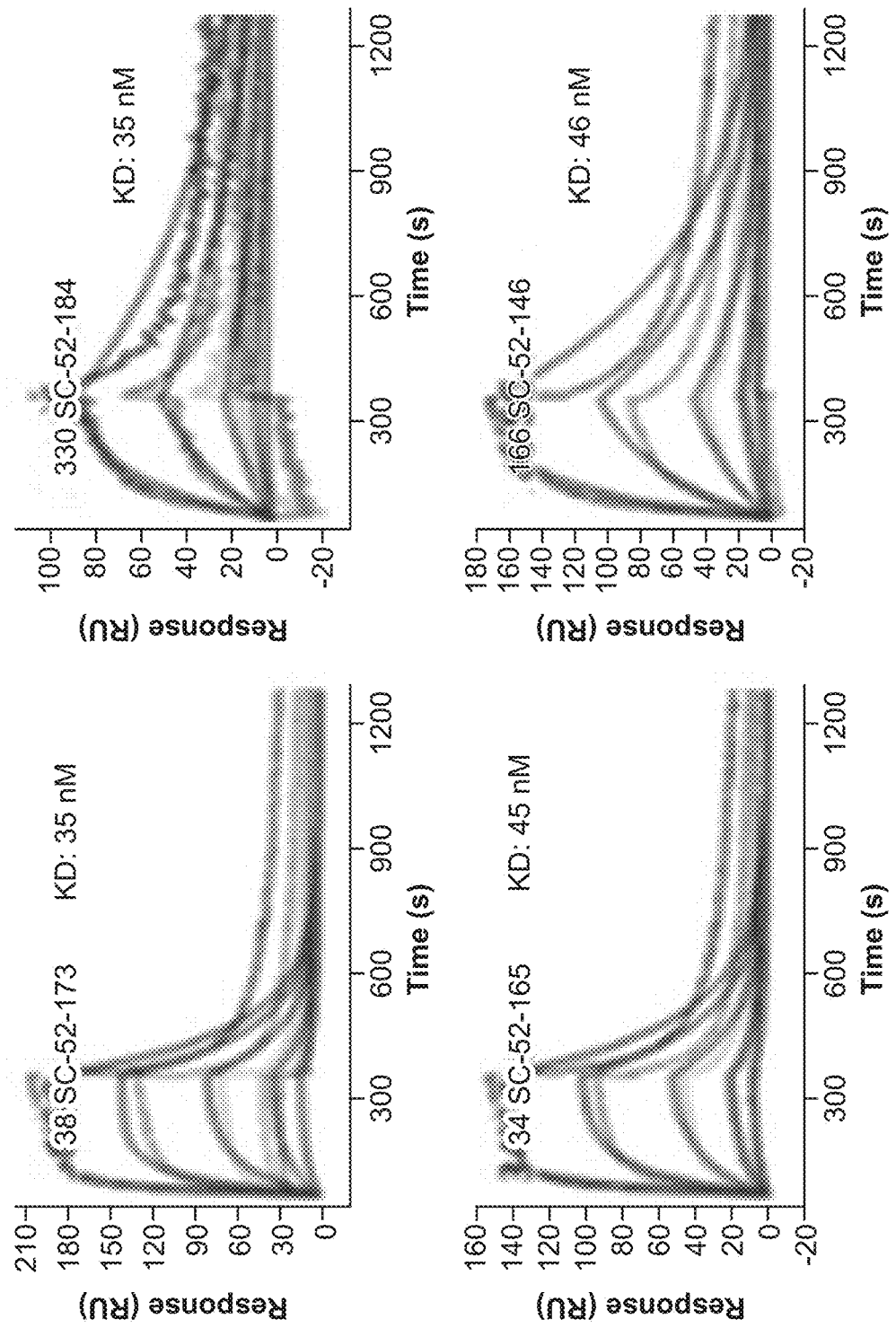
Figure 12A:
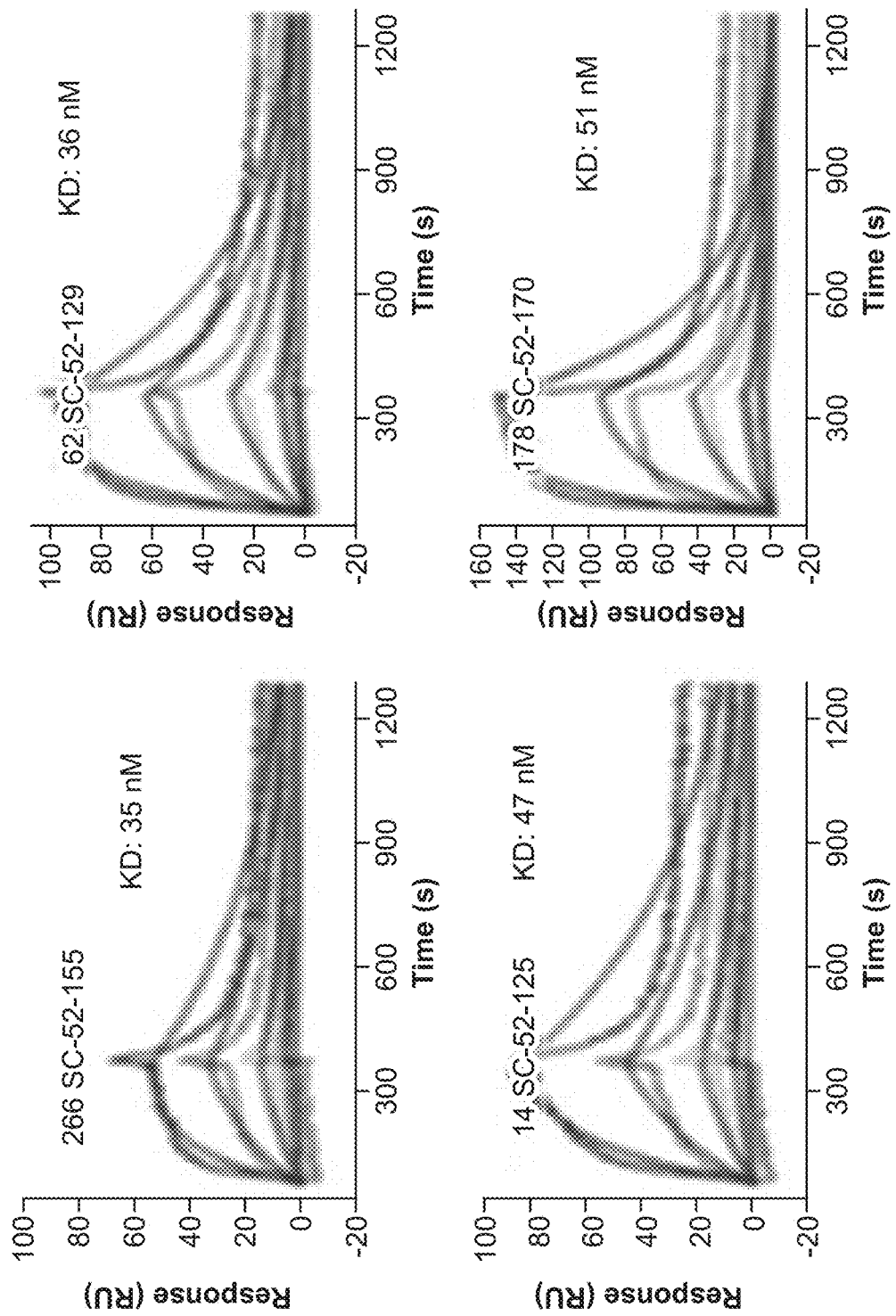
Figure 12A:
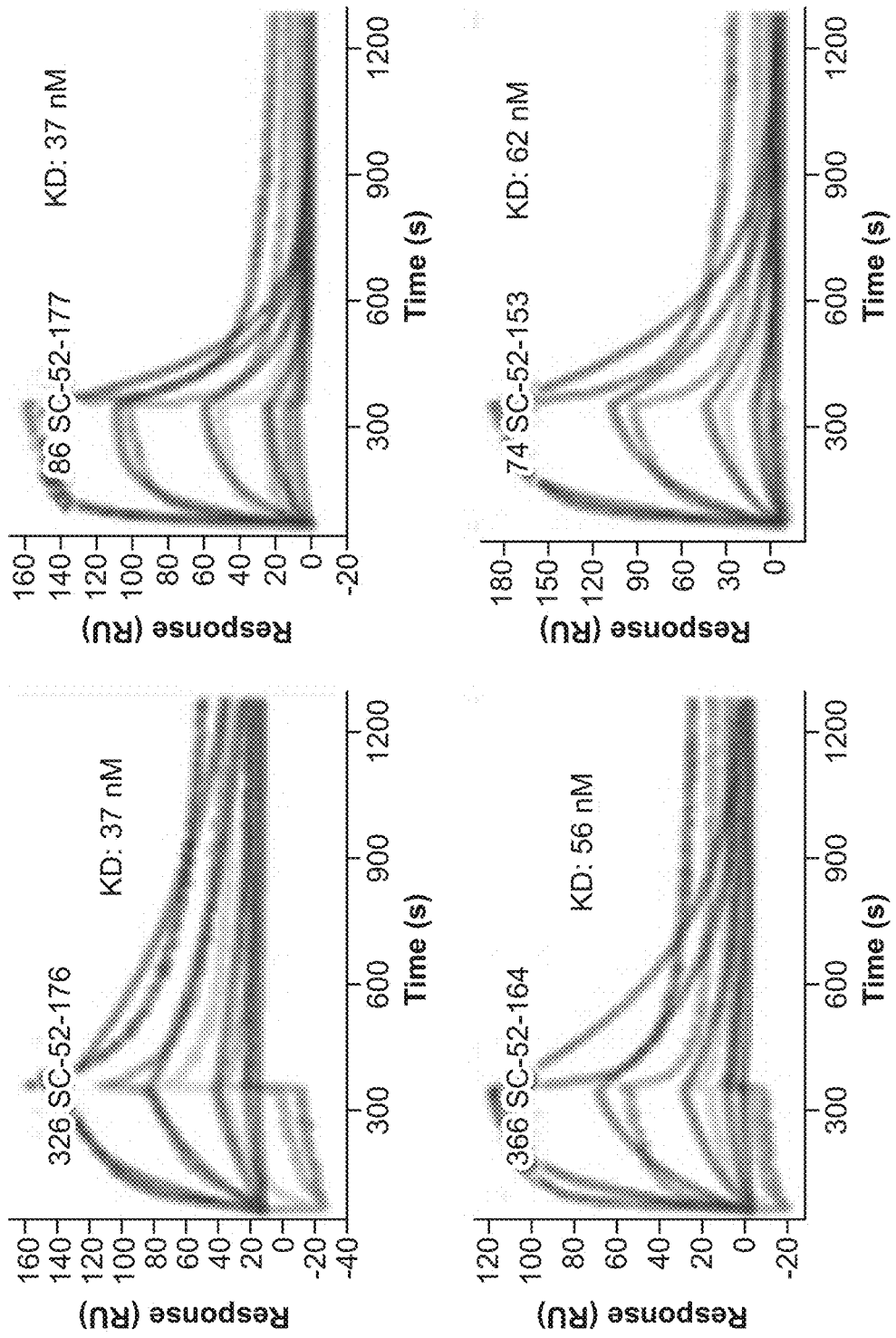
Figure 12A:
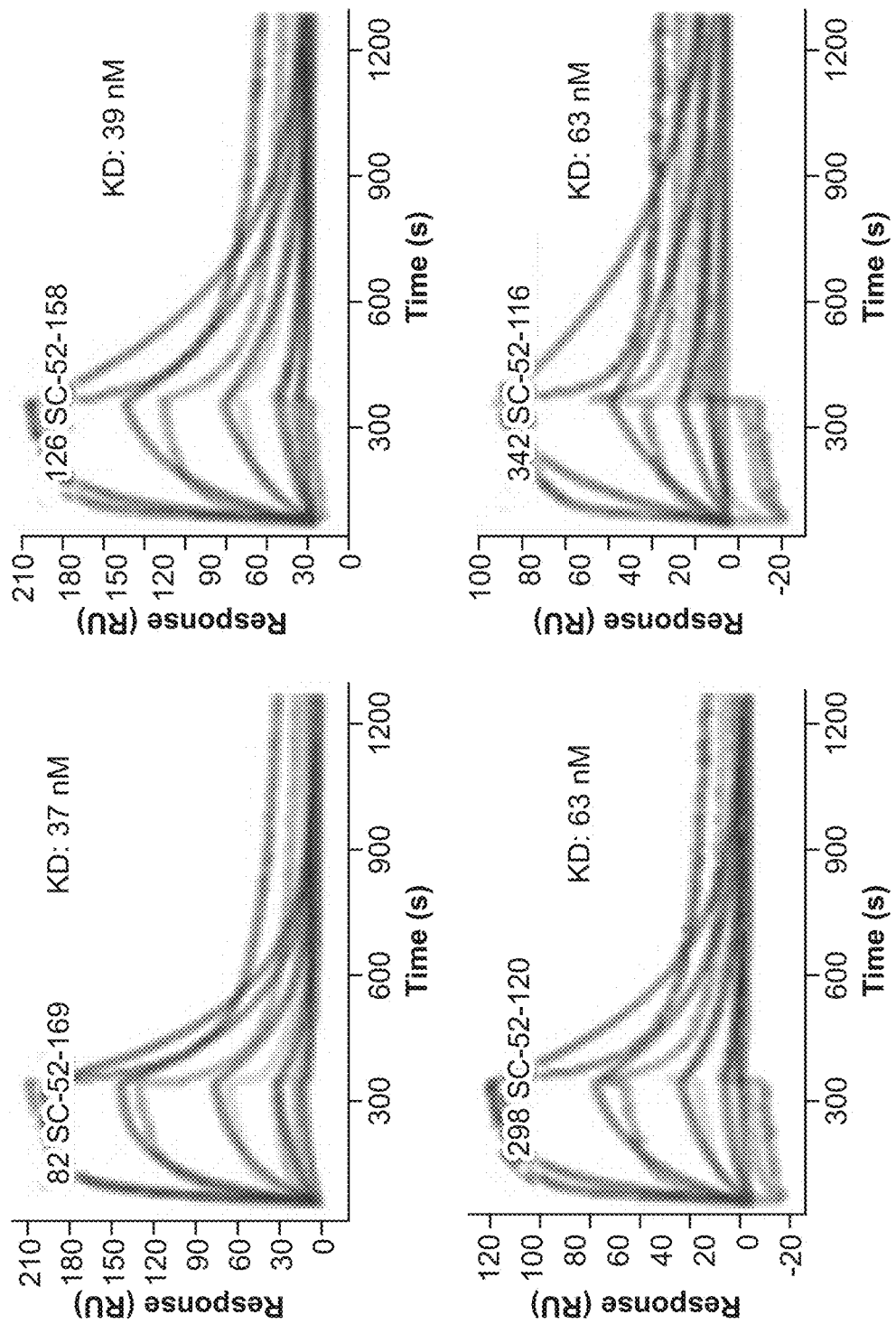
Figure 12A:
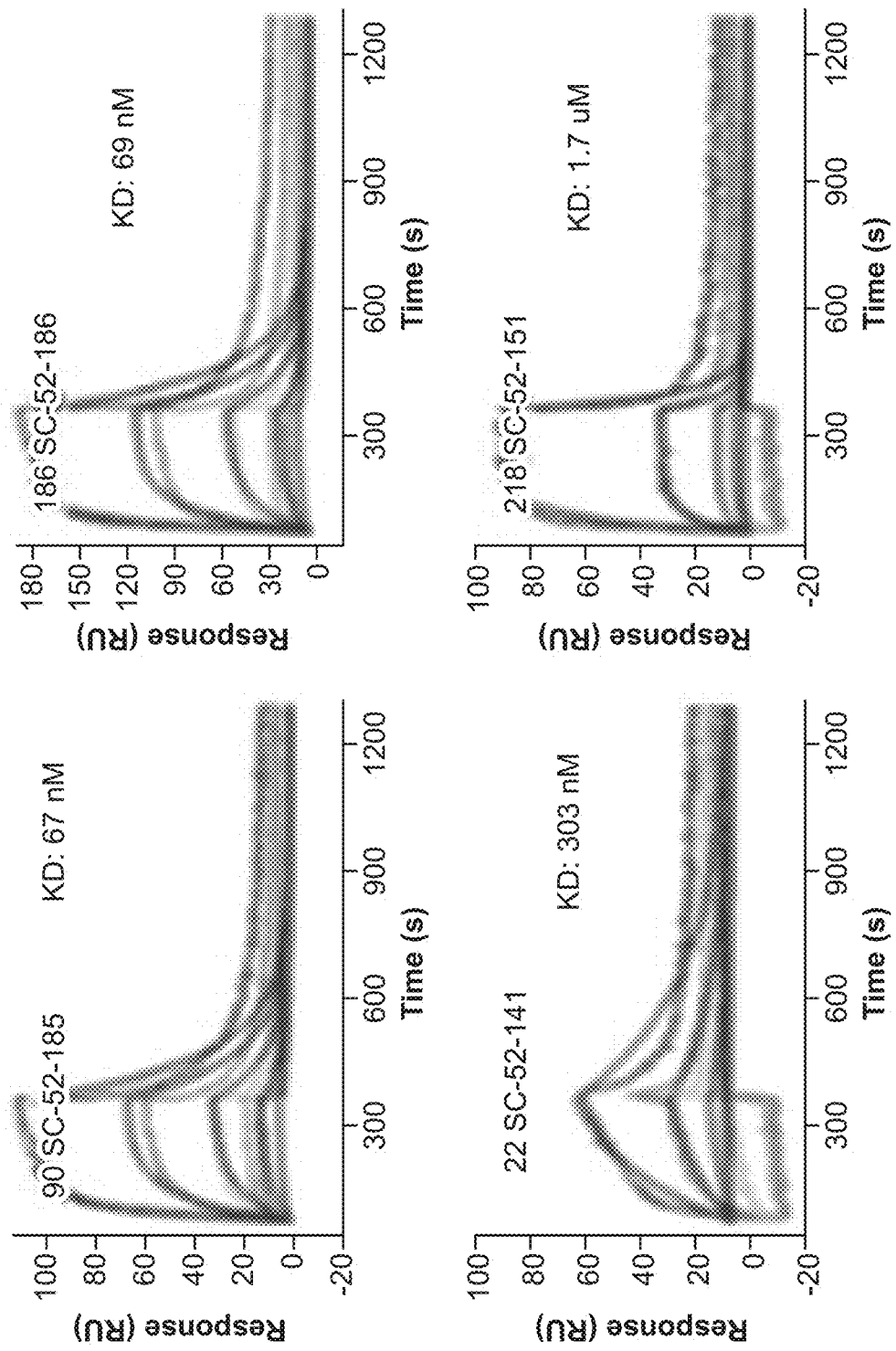
Figure 12A:
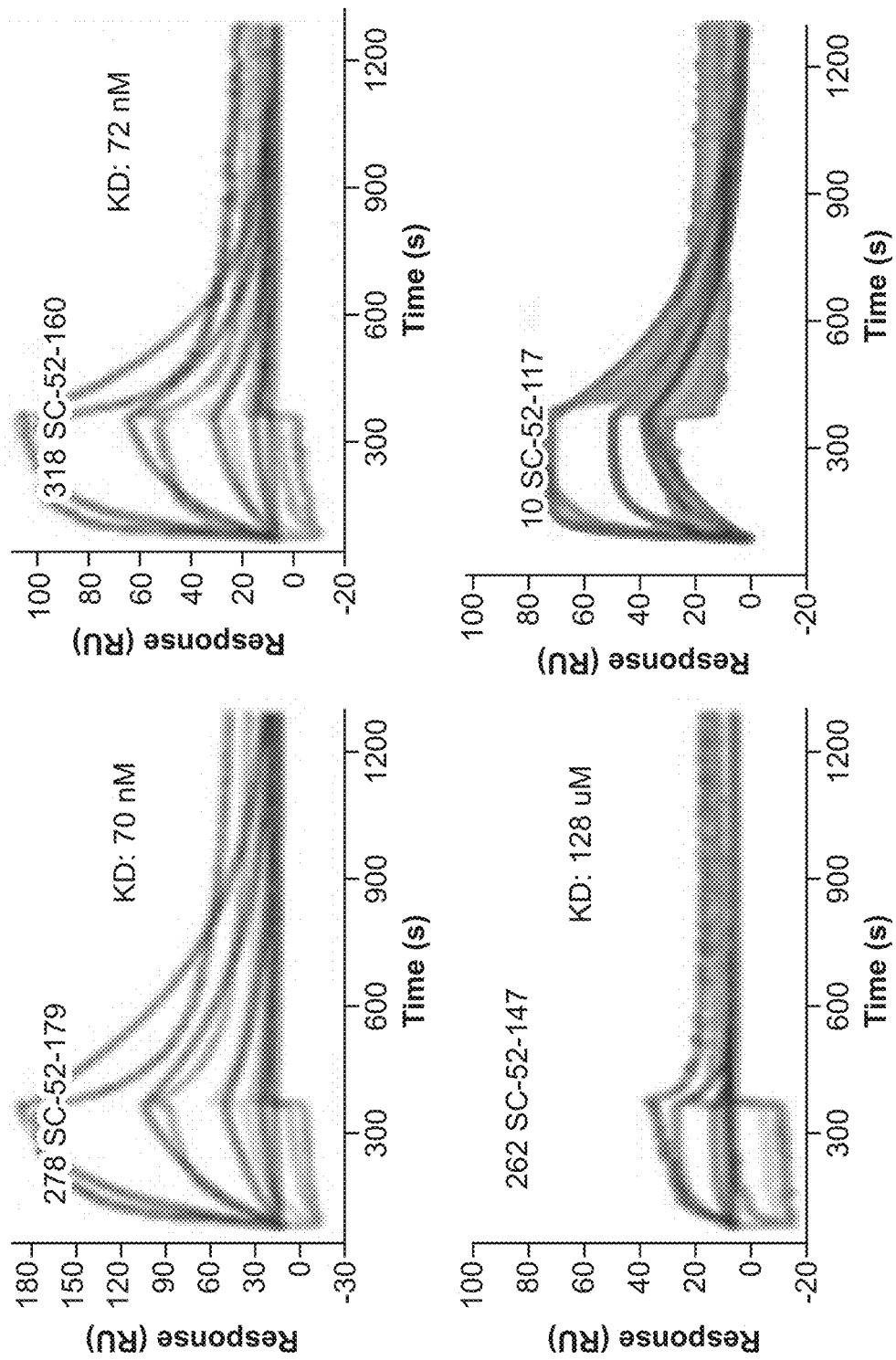
Figure 12A:
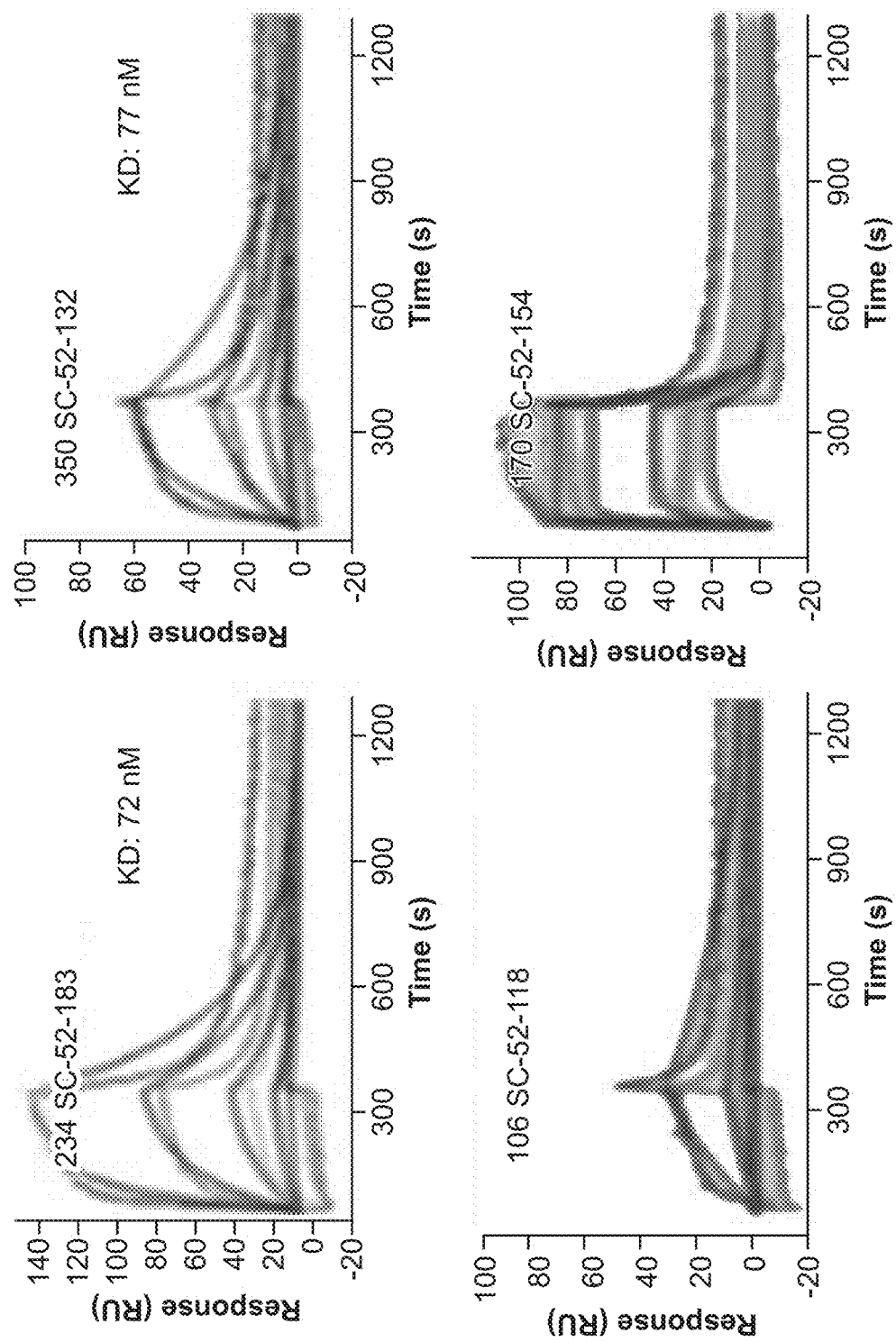
Figure 12A:
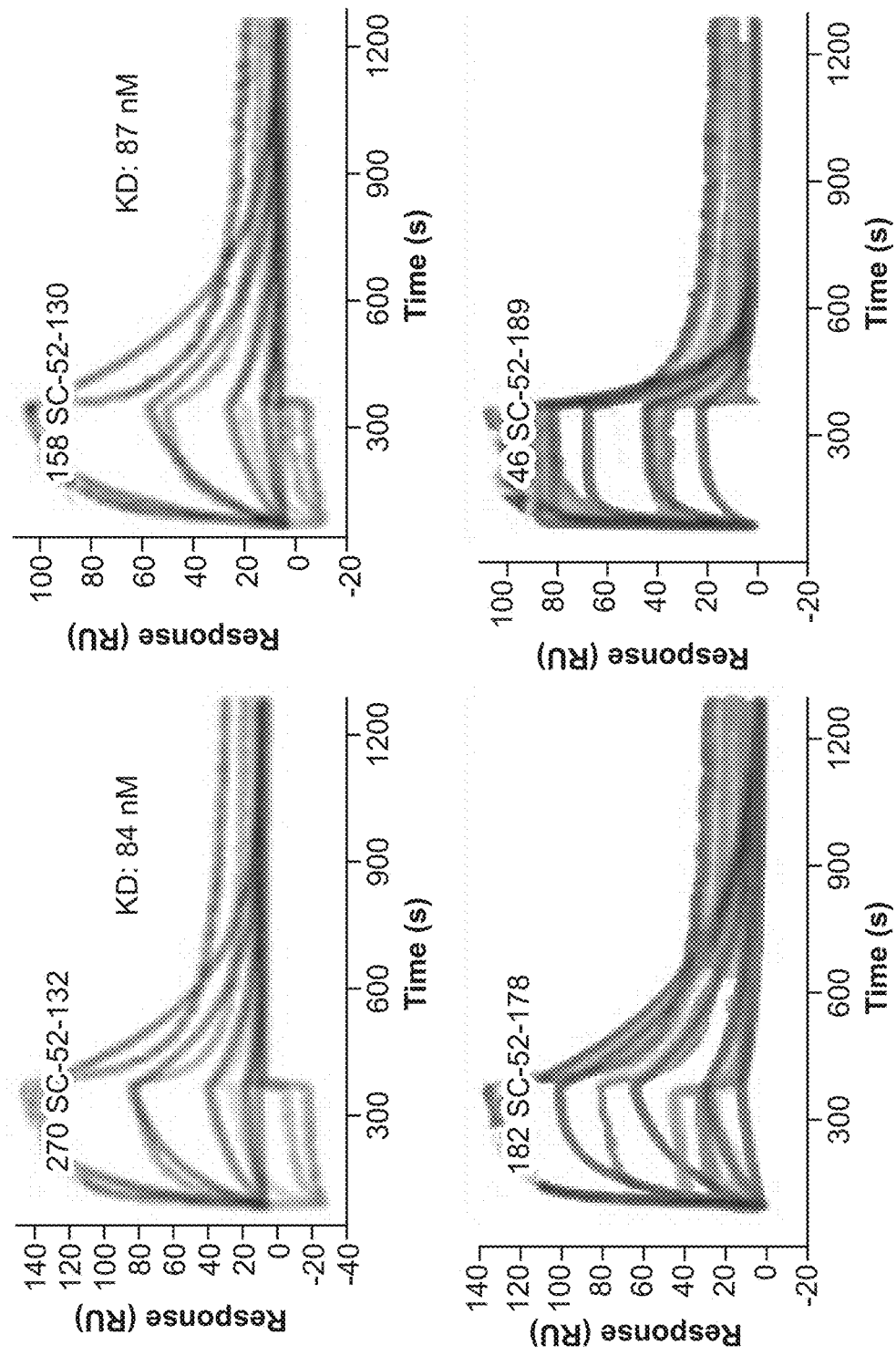
Figure 12A:
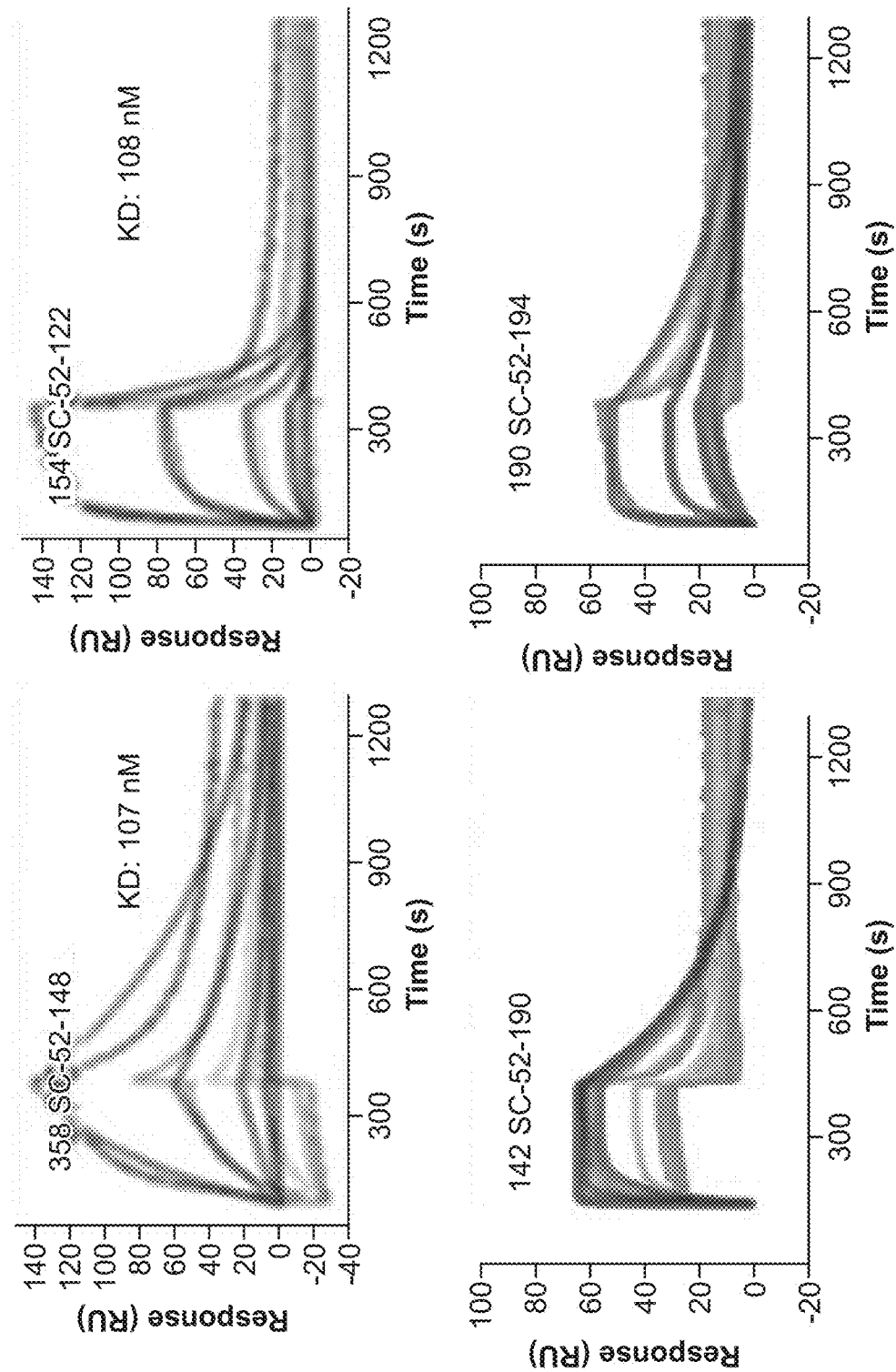
Figure 12A:
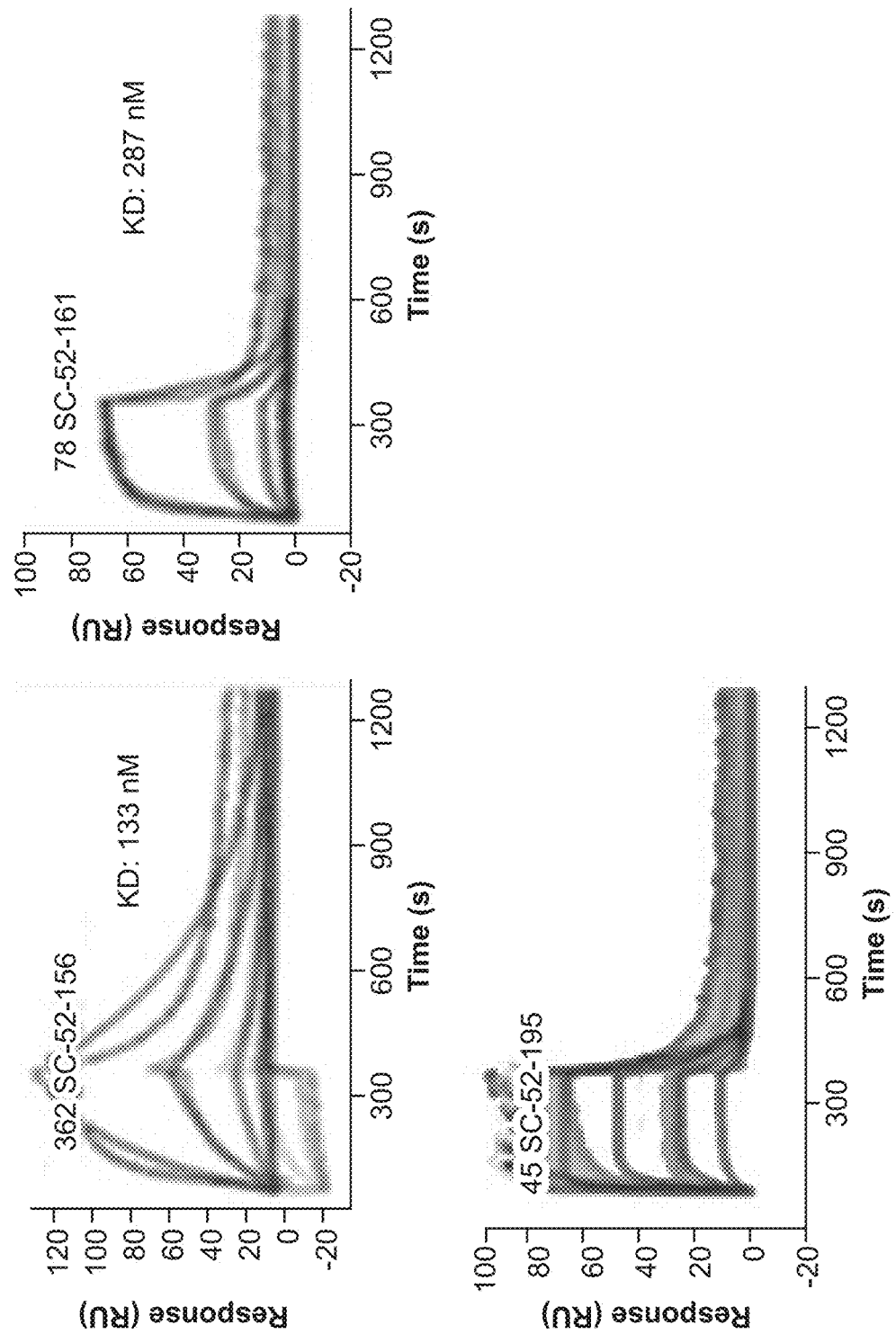
Figure 12B:
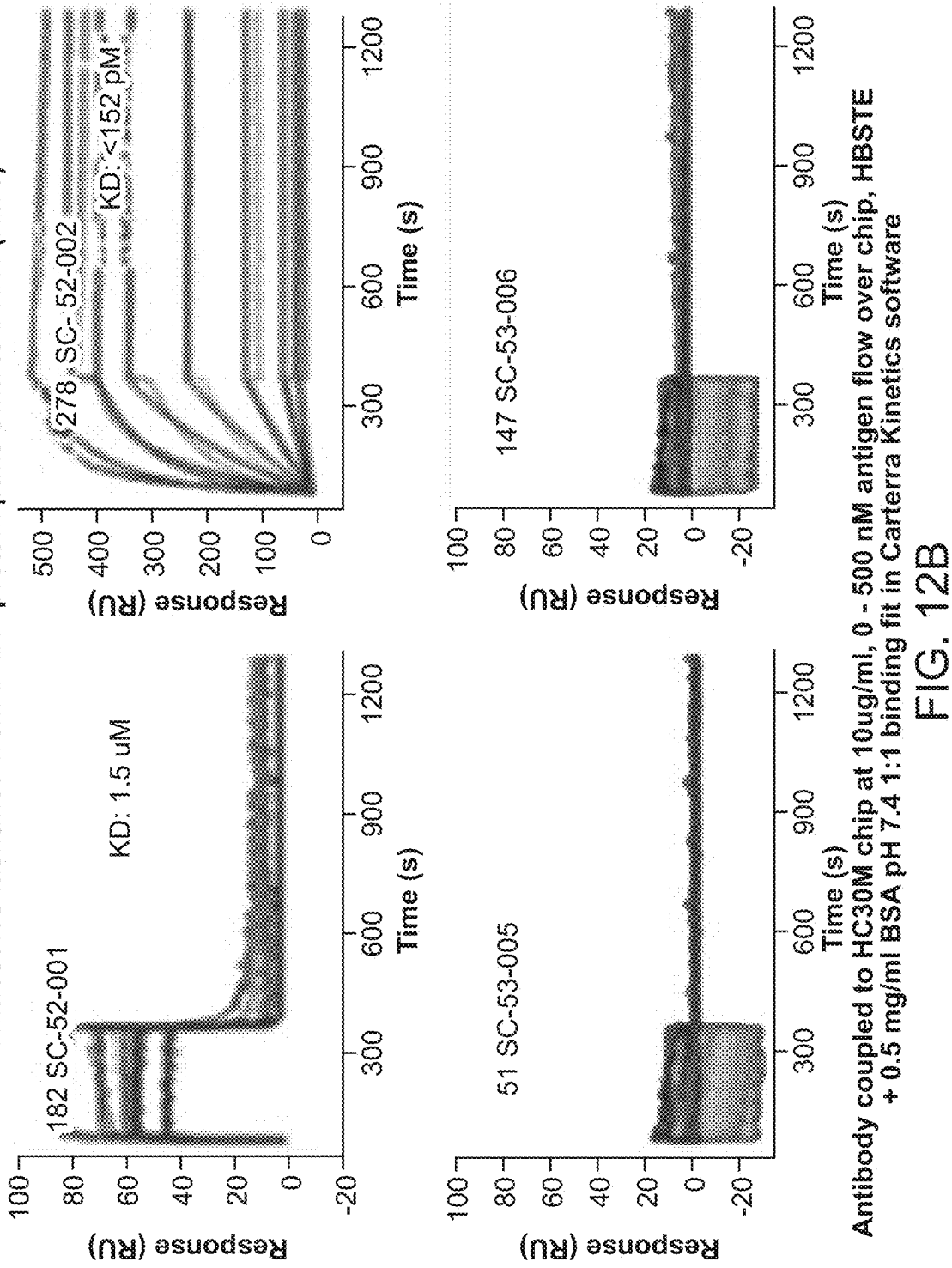
FIG. 12B depicts Carterra SPR kinetic graphs showing VHH-Fc hits identified from ELISA screening binding with high affinity to DKK1.
Figure 12B:
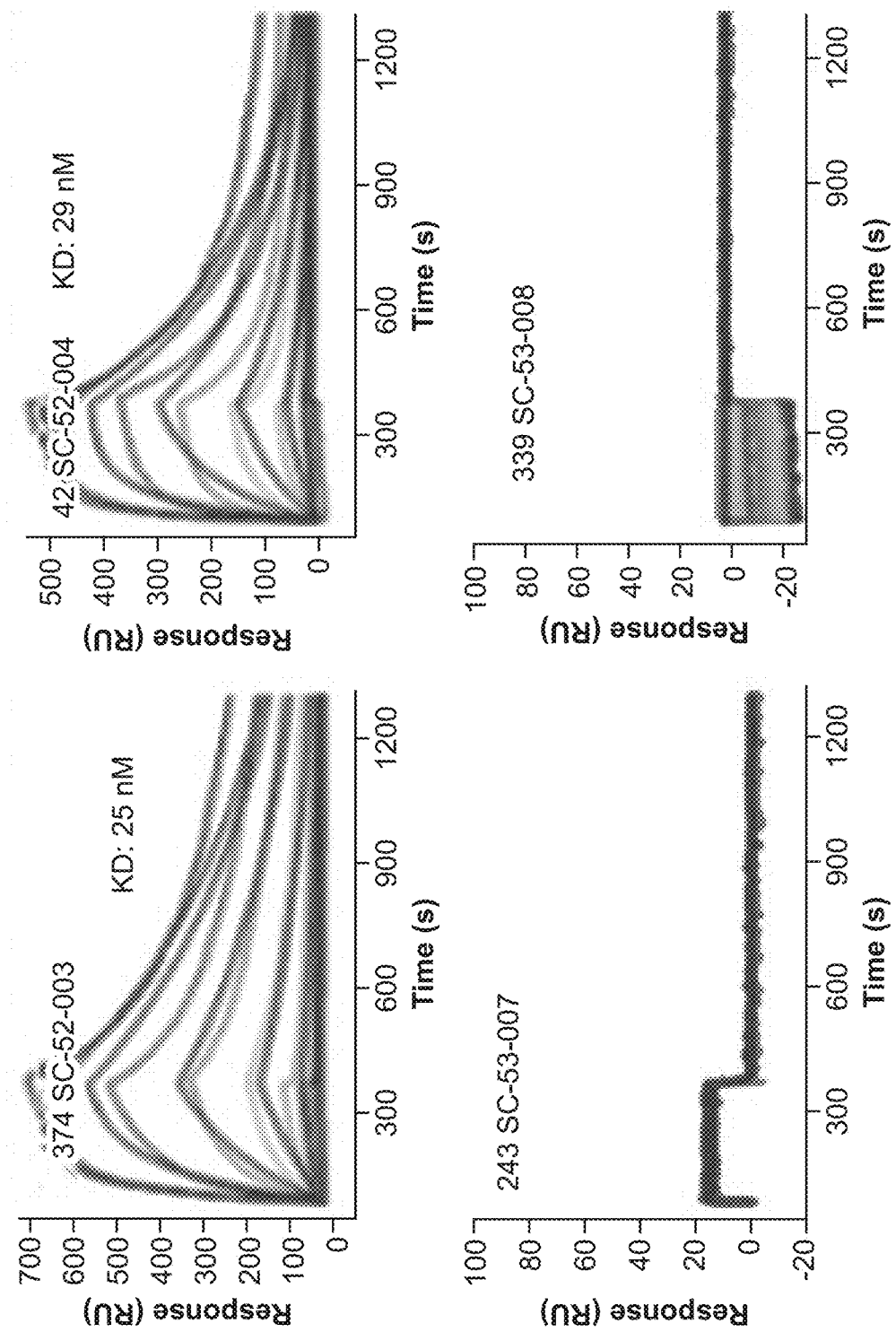
Figure 12B:
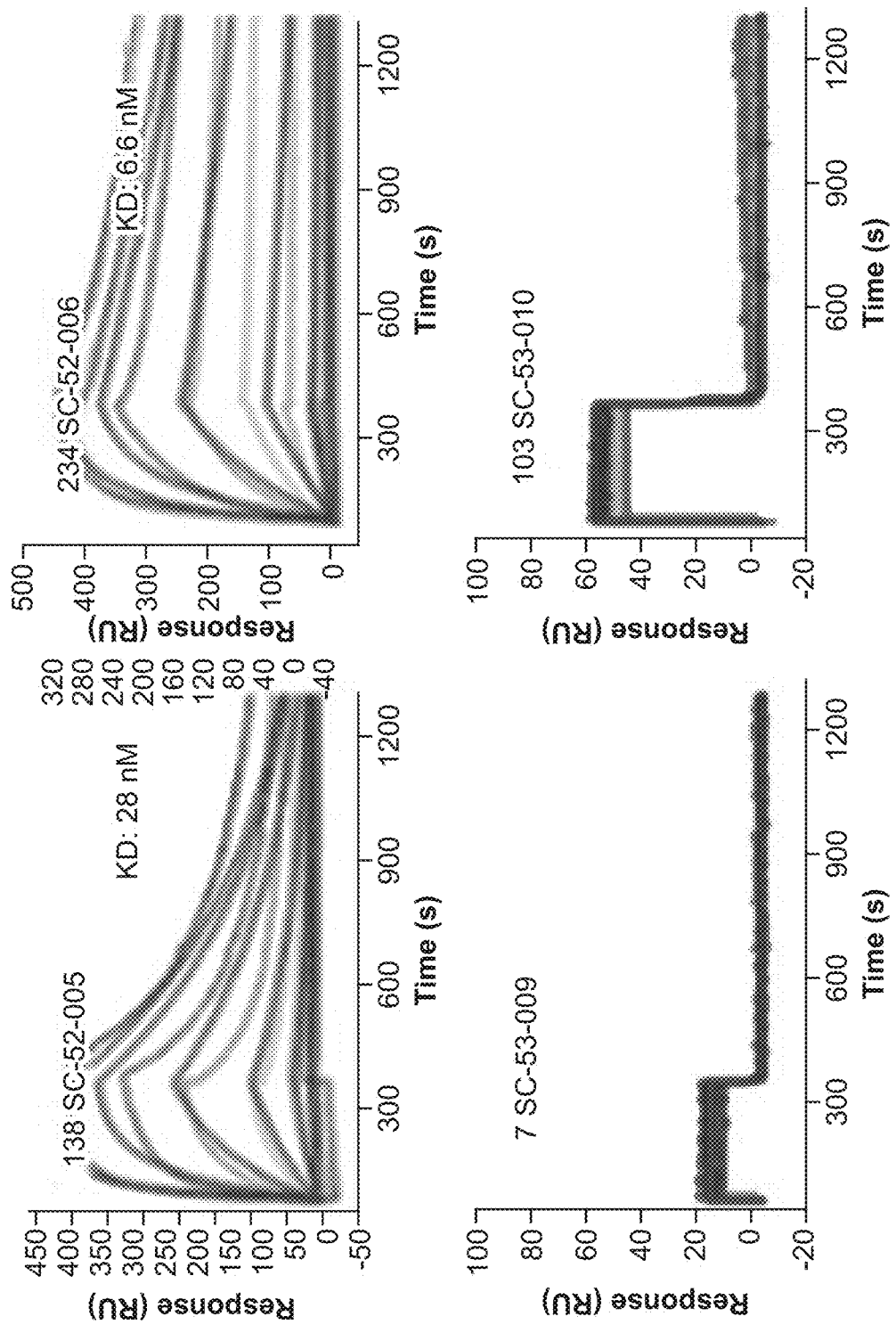
Figure 12B:
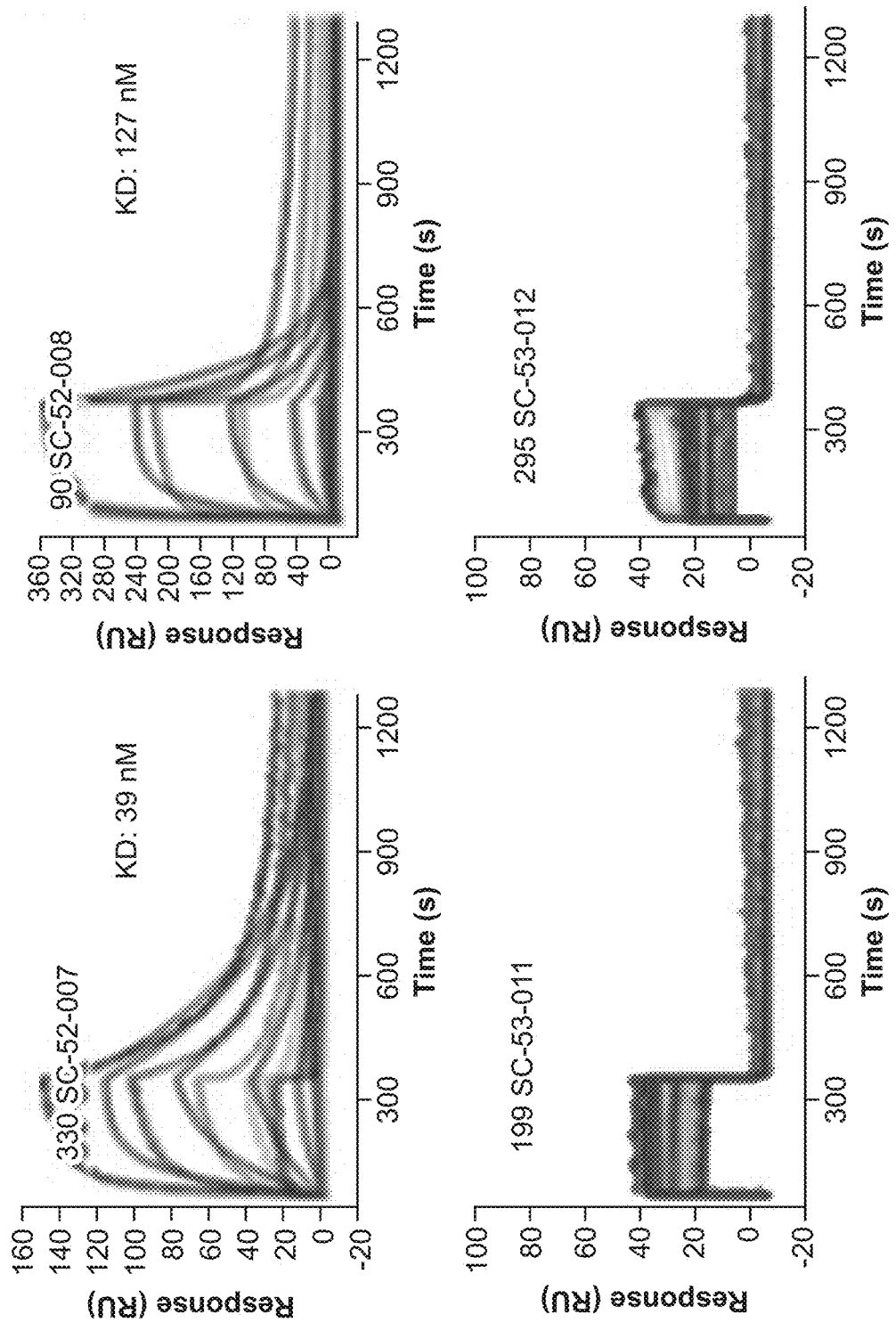
Figure 12B:
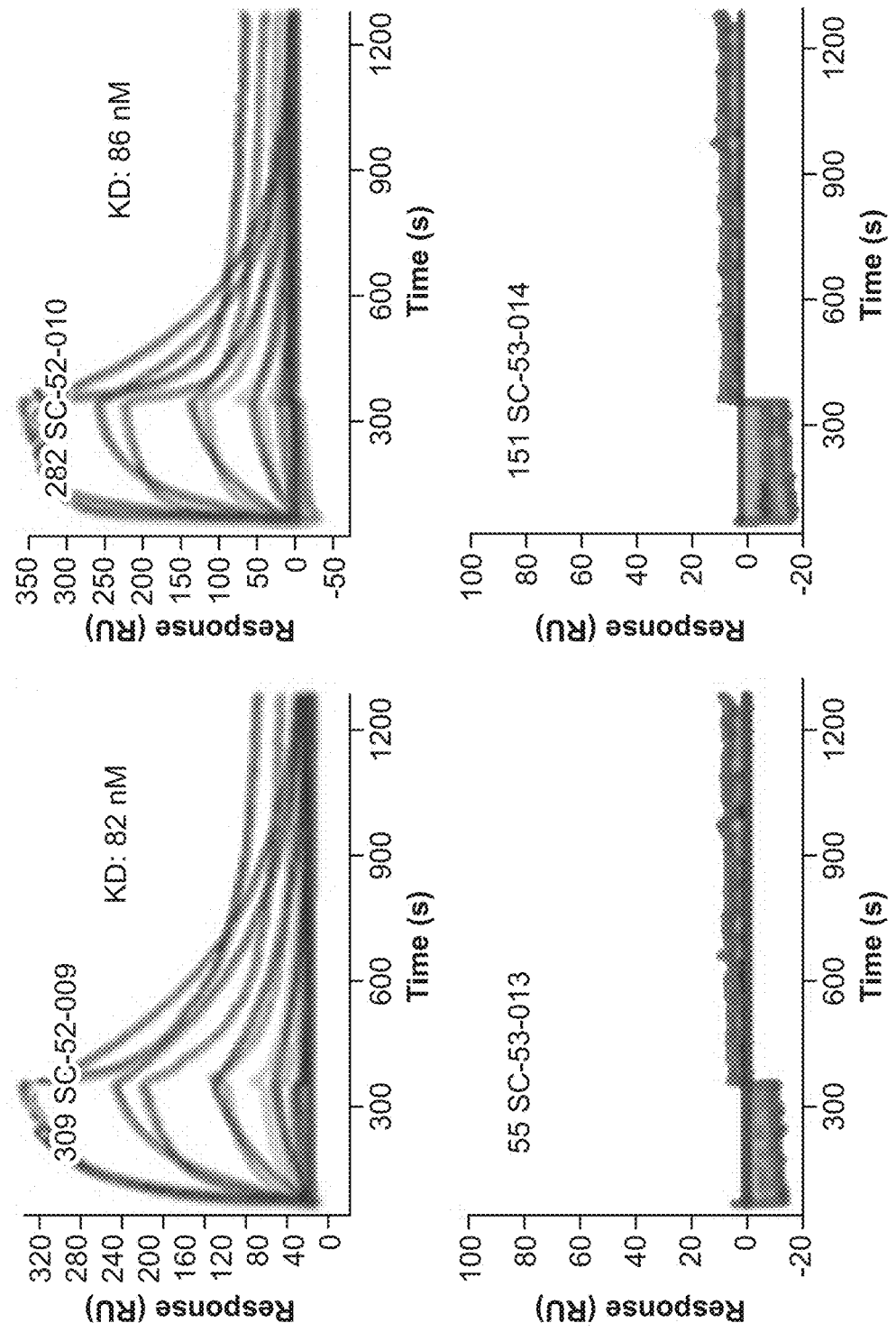
Figure 12B:
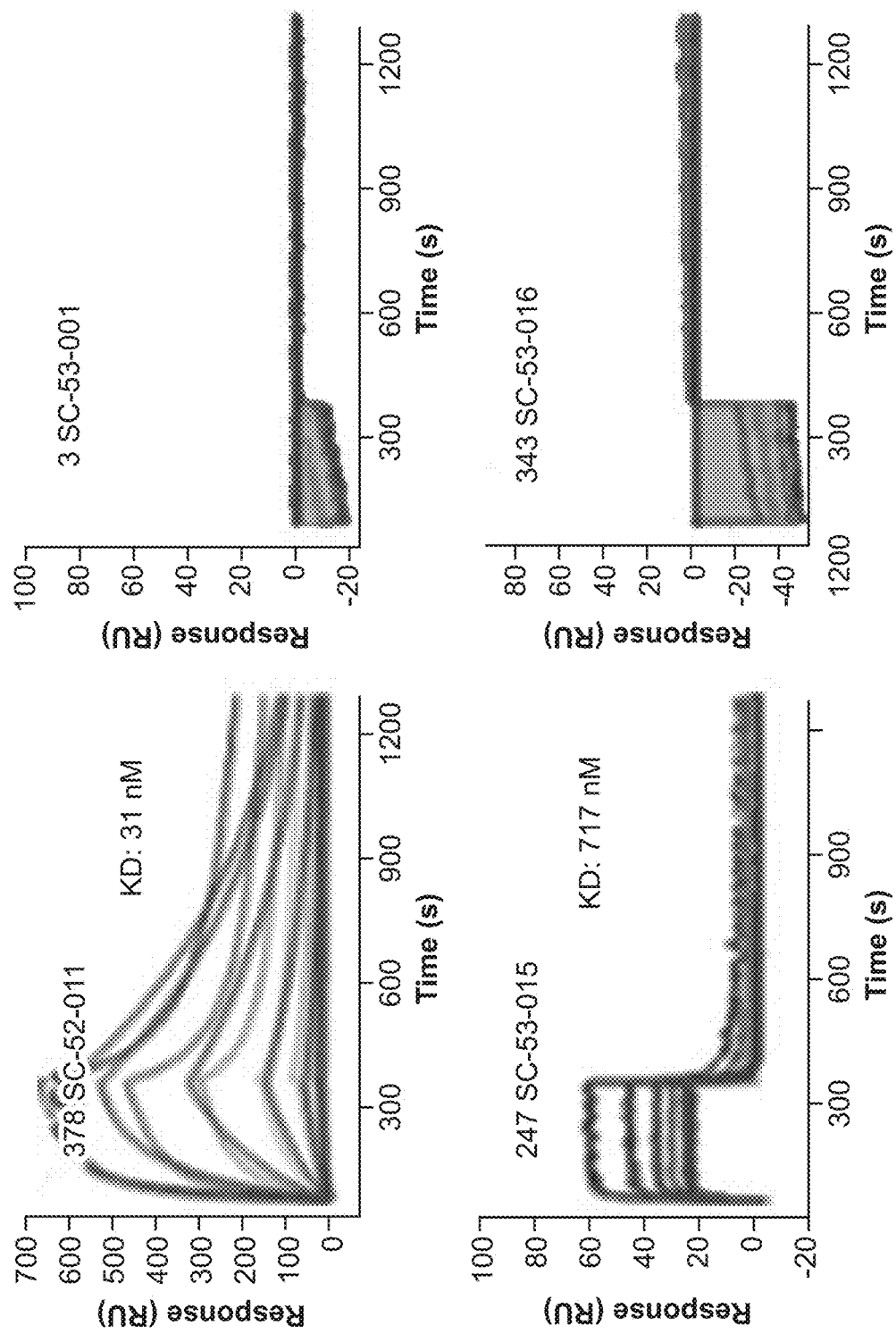
Figure 12B:
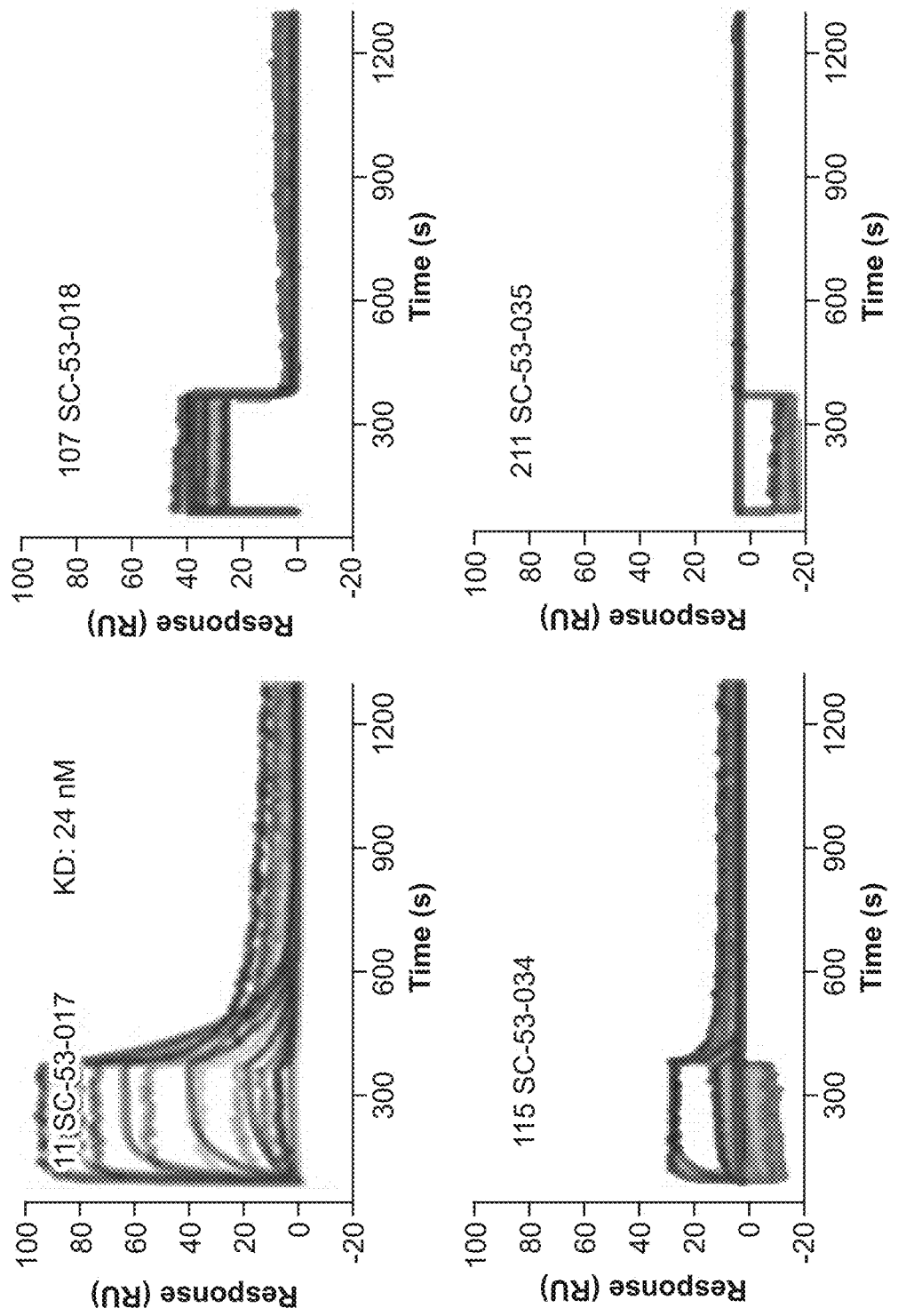
Figure 12B:
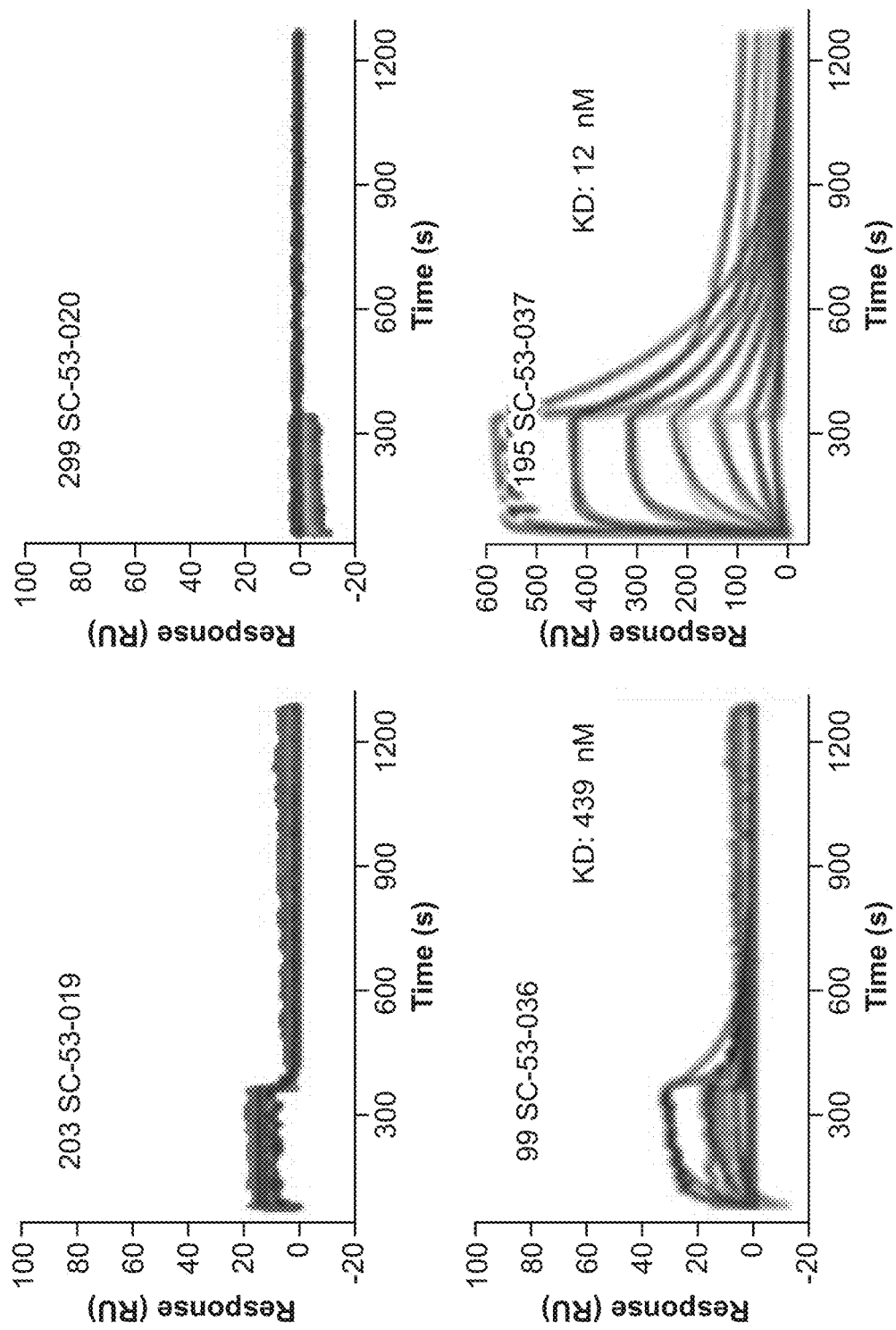
Figure 12B:
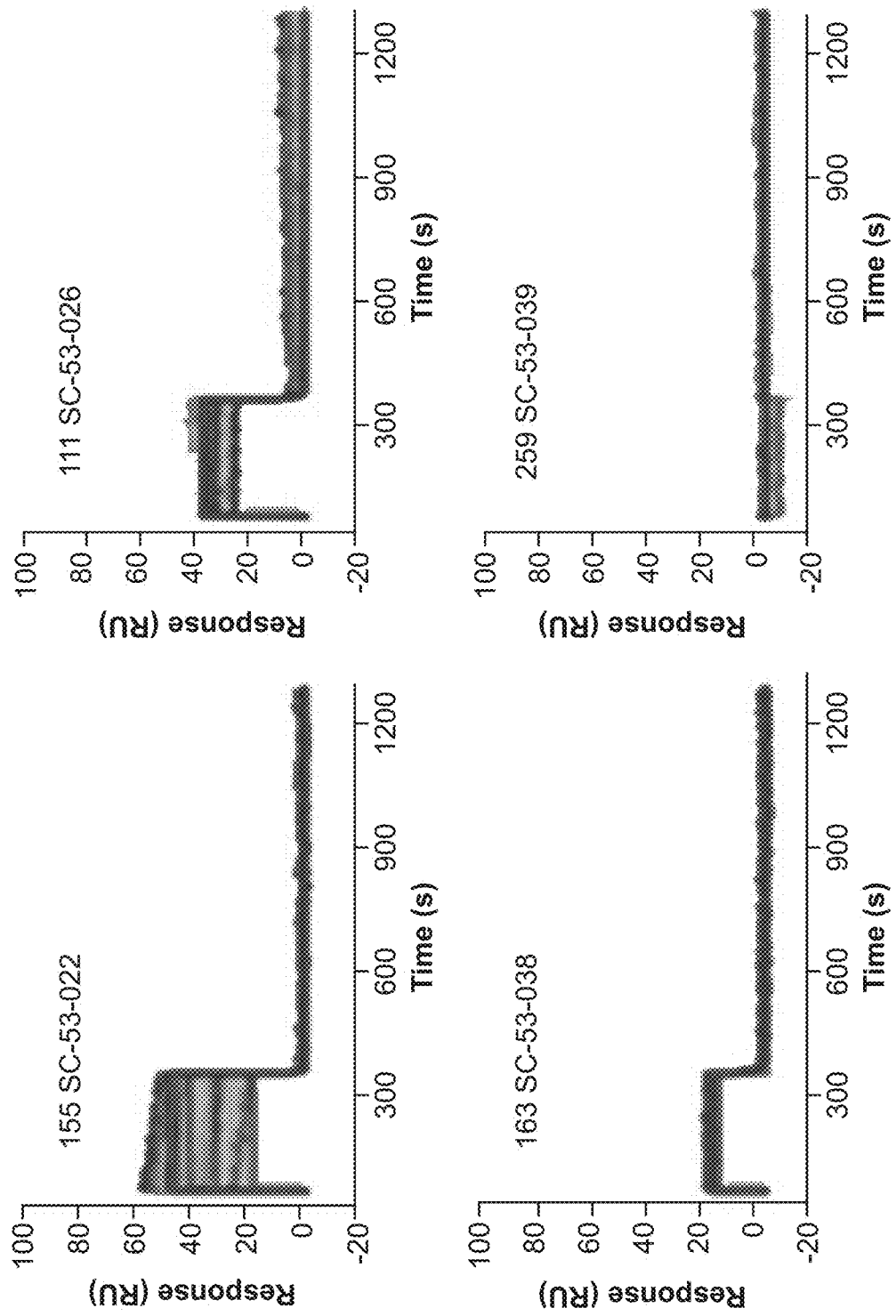
Figure 12B:
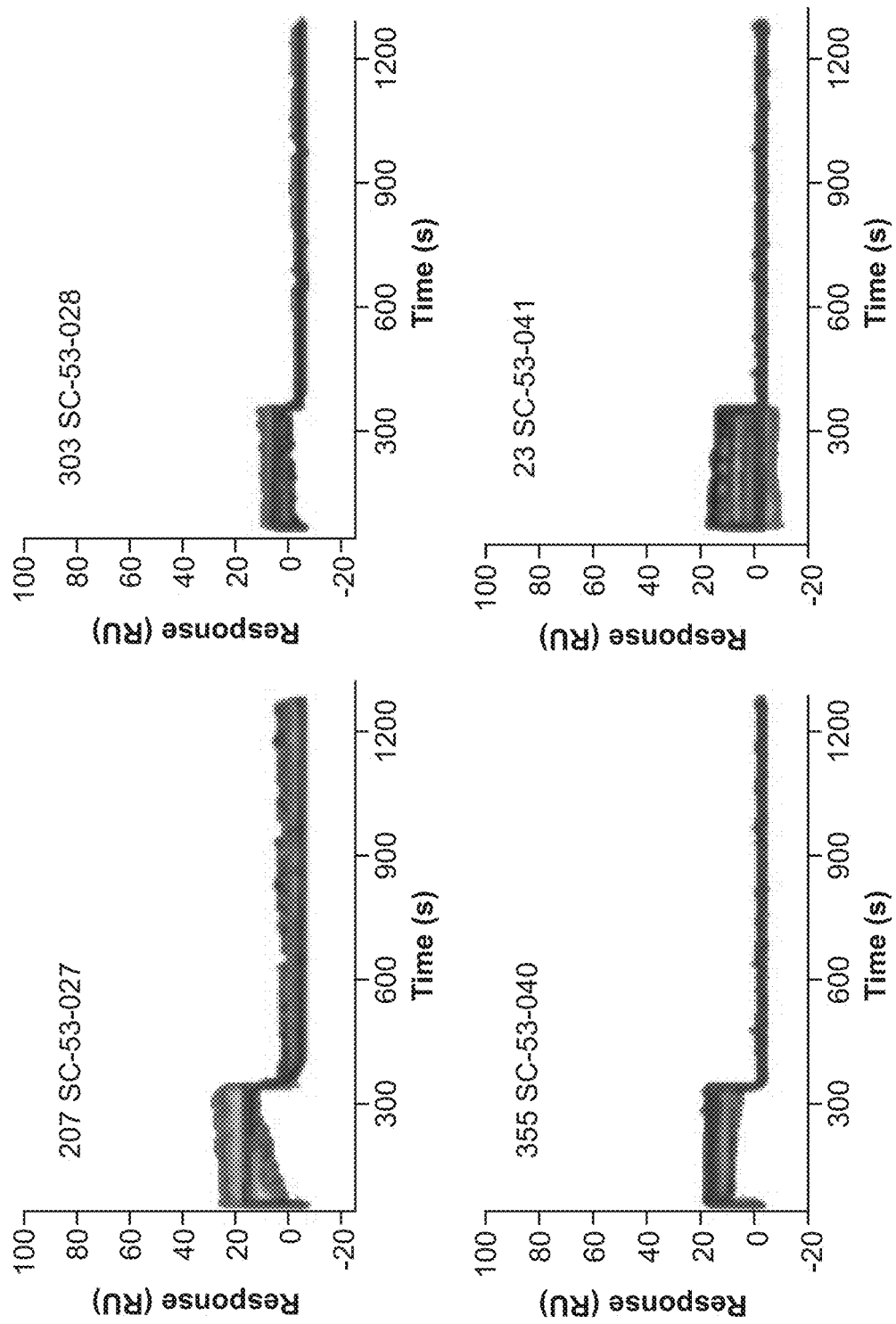
Figure 12B:
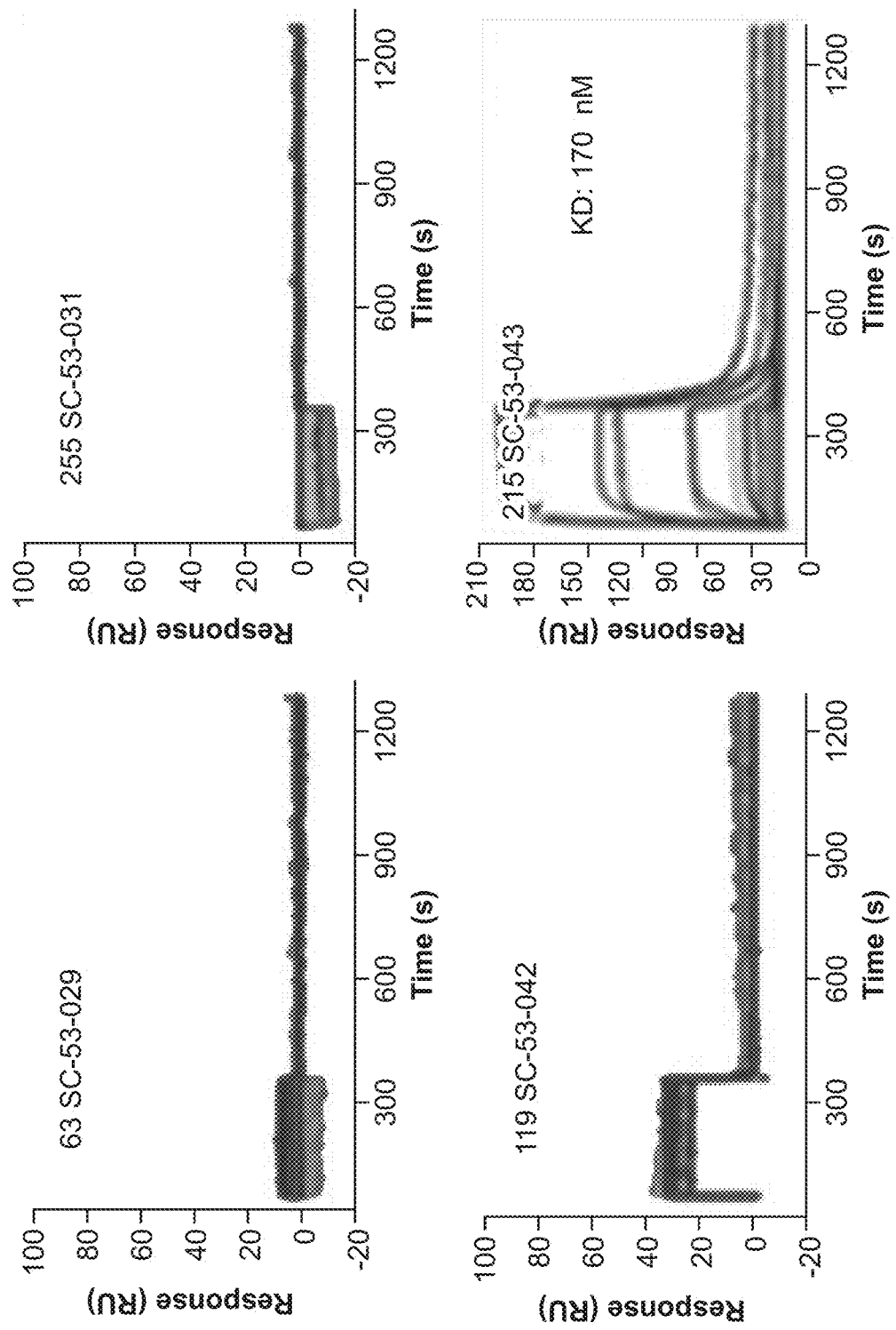
Figure 12B:
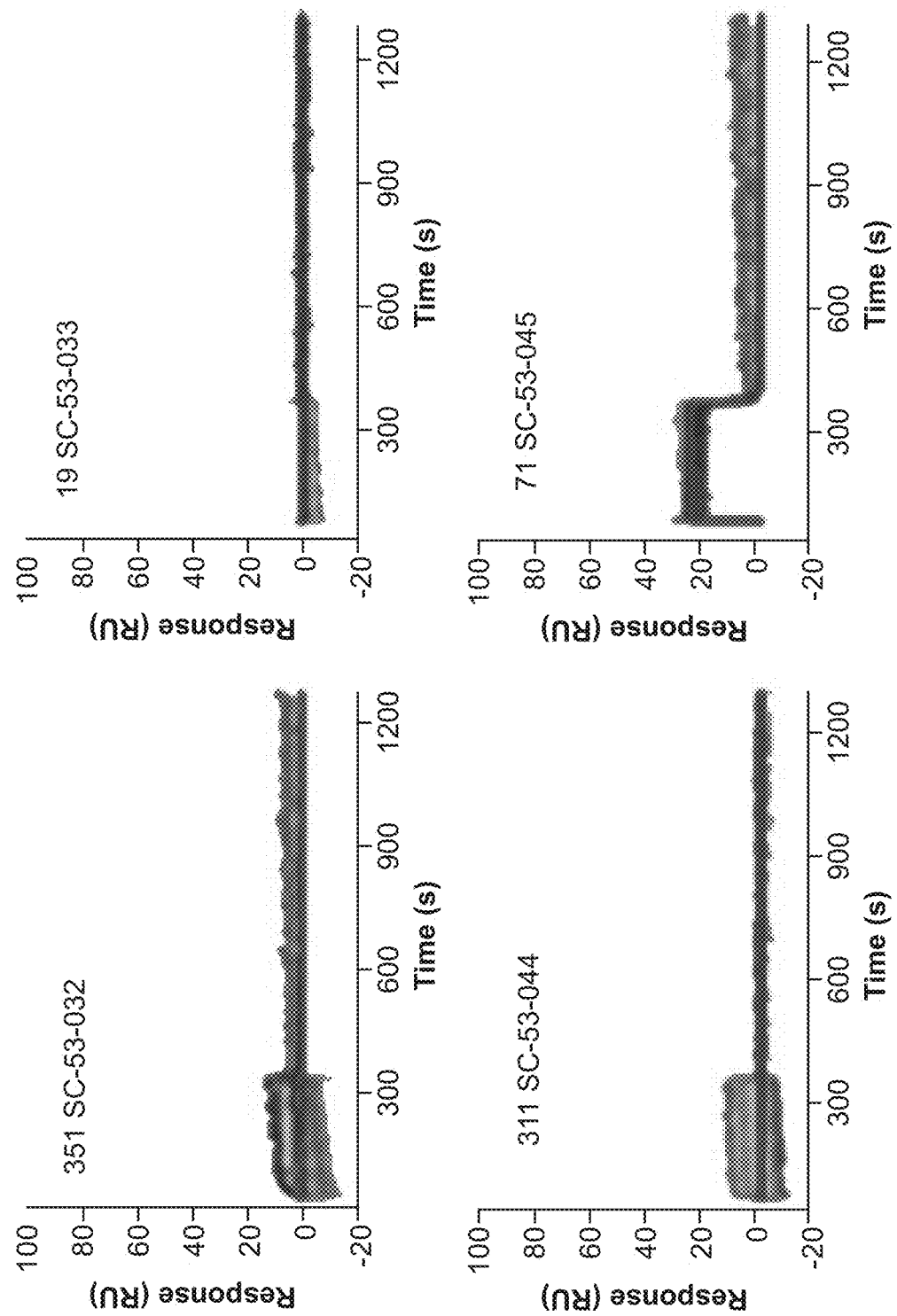
Figure 12B:
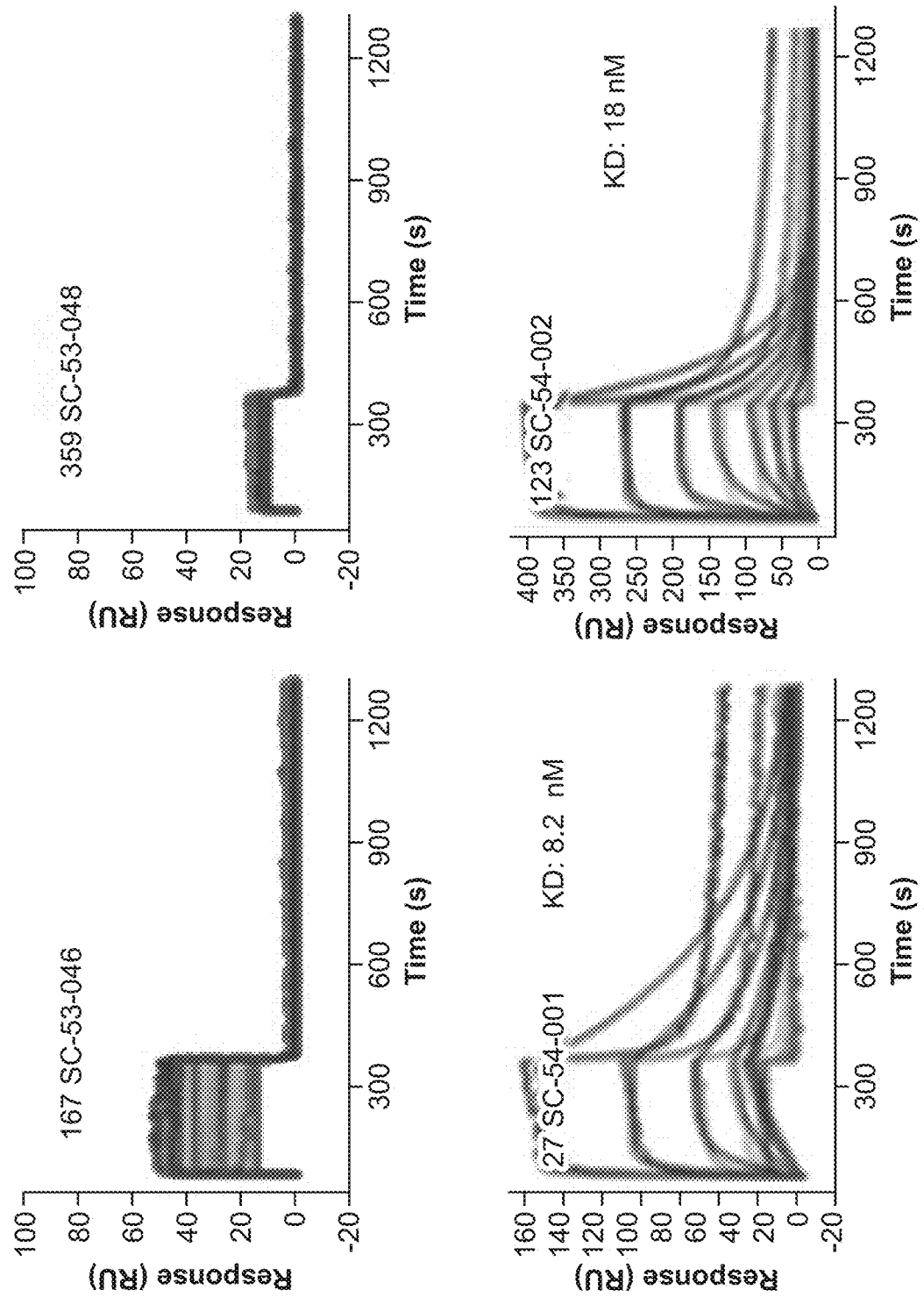
Figure 12B:
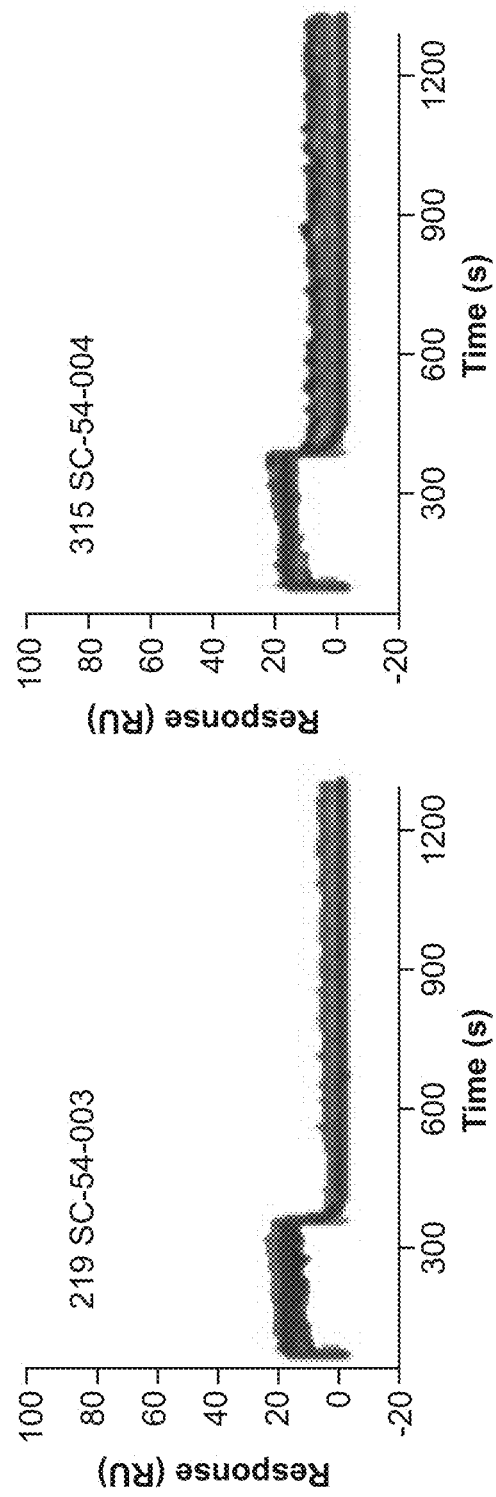
Figure 12C:
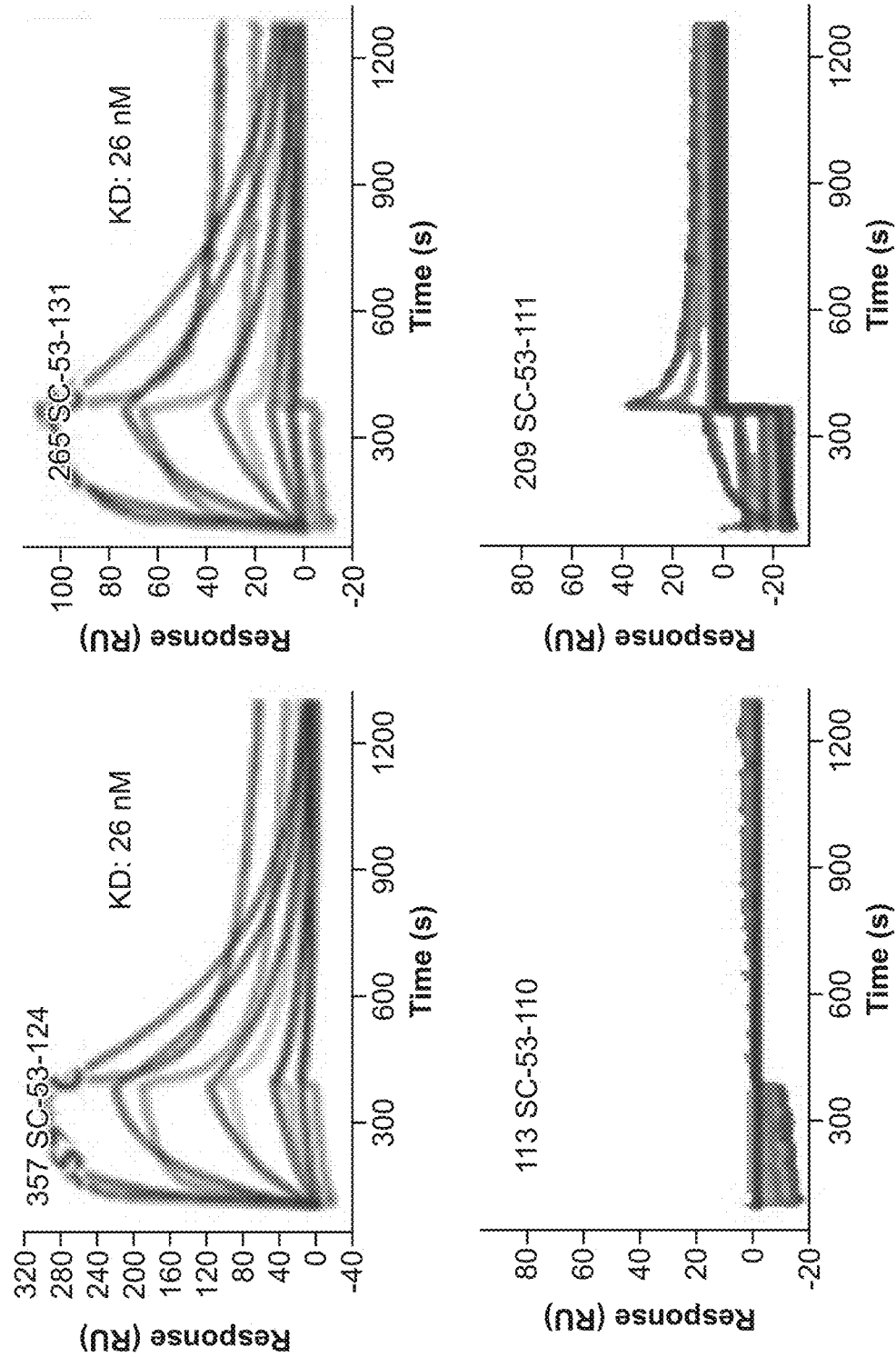
FIG. 12C depicts additional Carterra SPR kinetic graphs showing VHH-Fc hits identified from NGS sequencing binding with high affinity to DKK1.
Figure 12C:
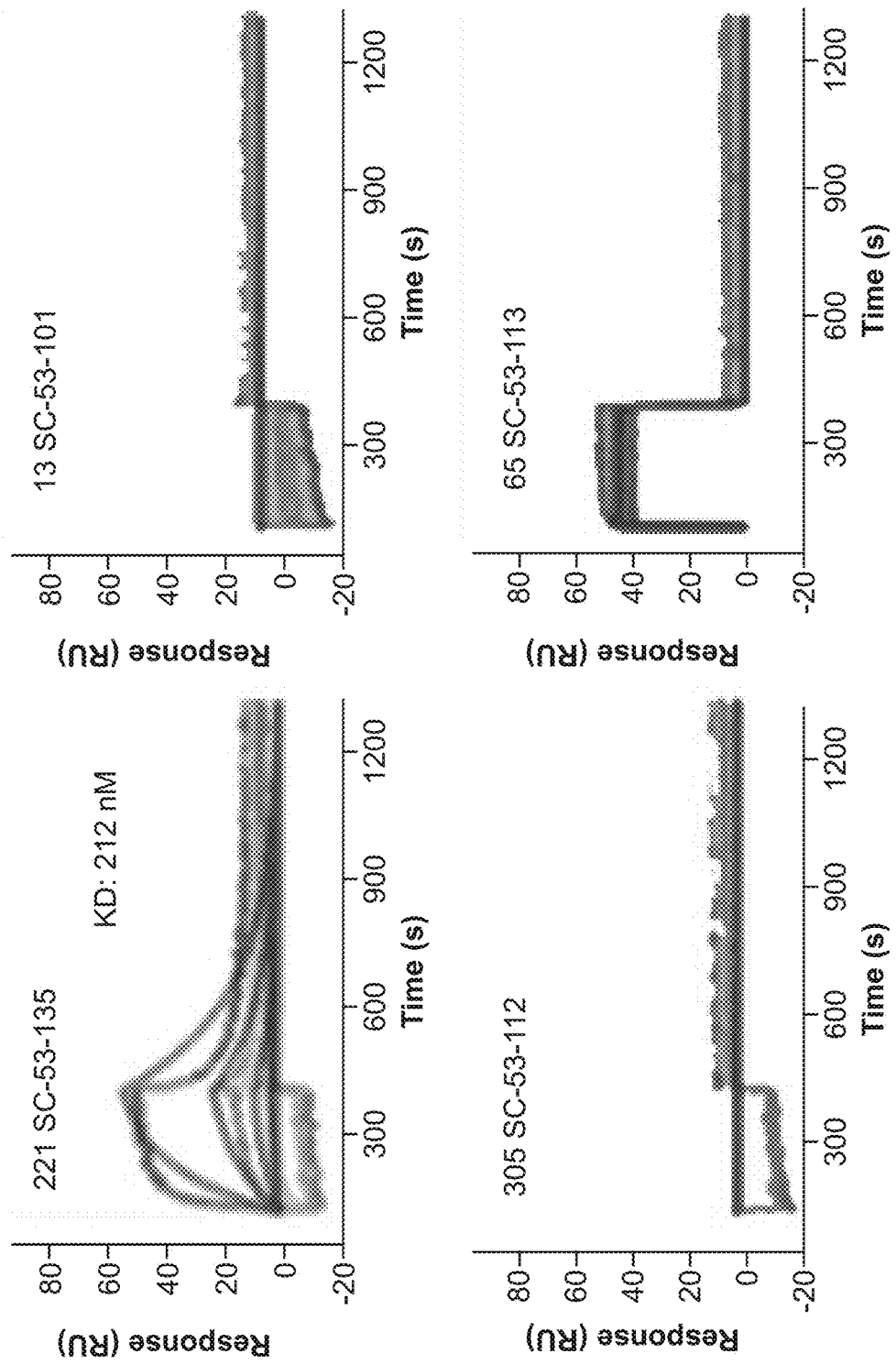
Figure 12C:
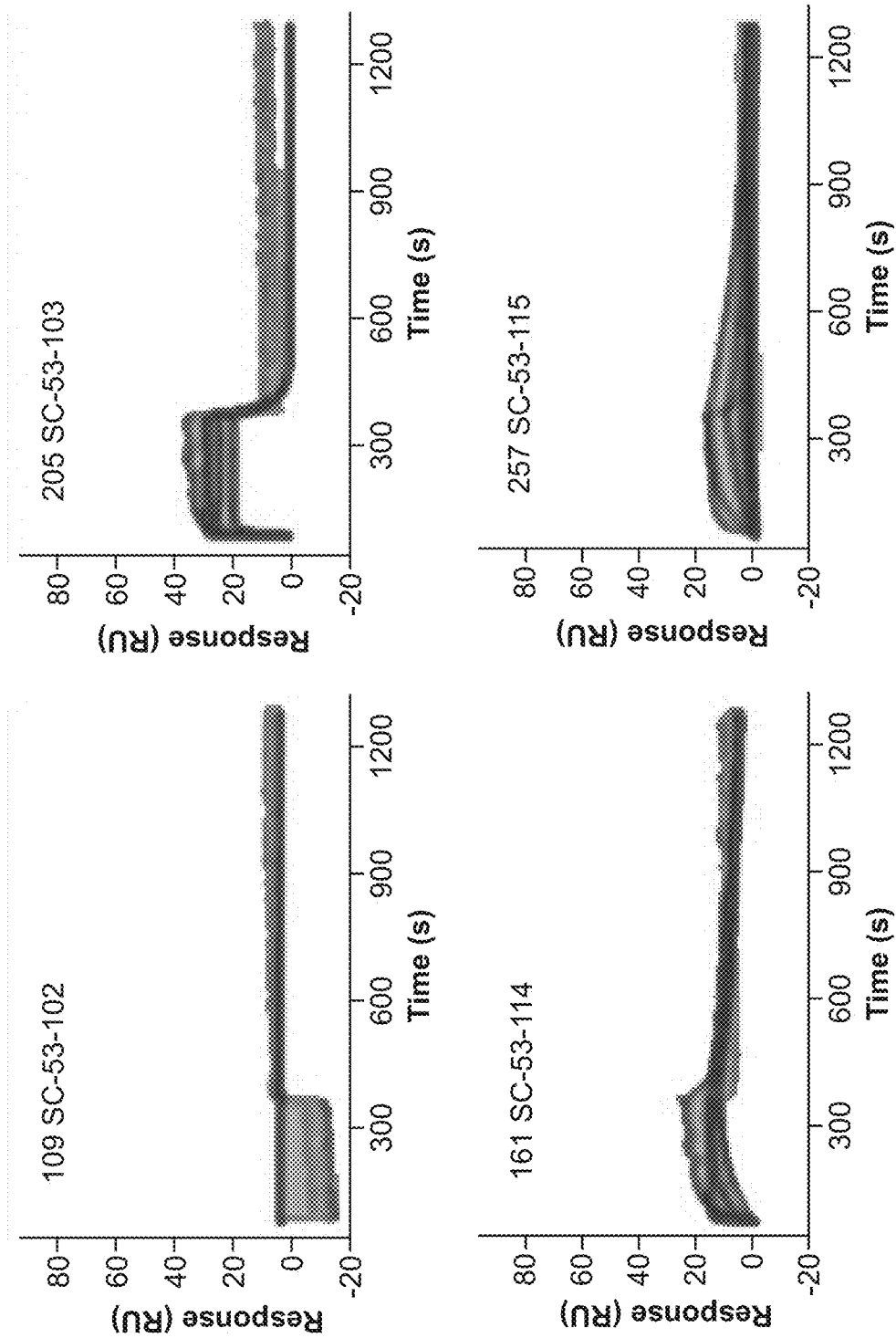
Figure 12C:
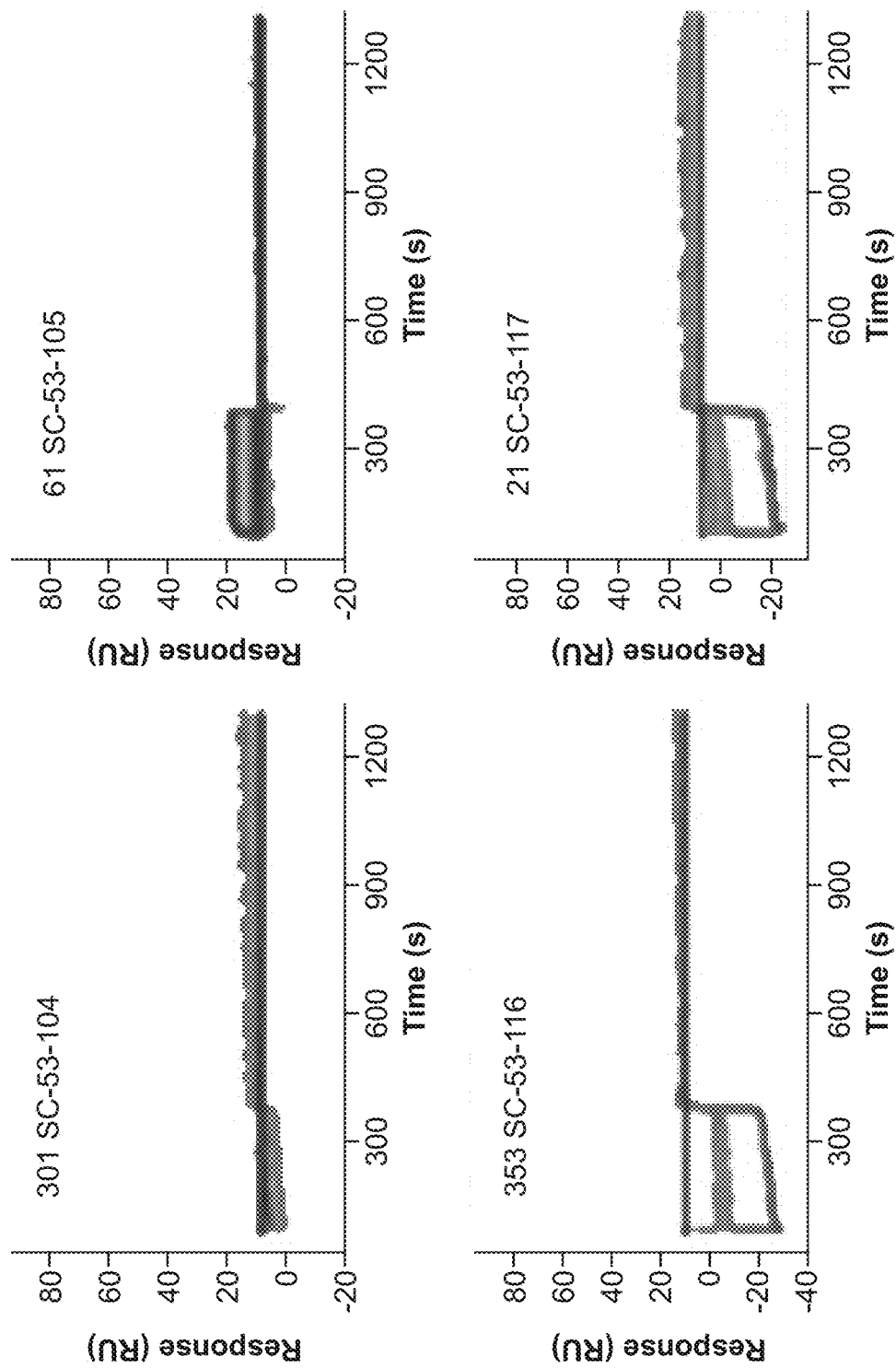
Figure 12C:
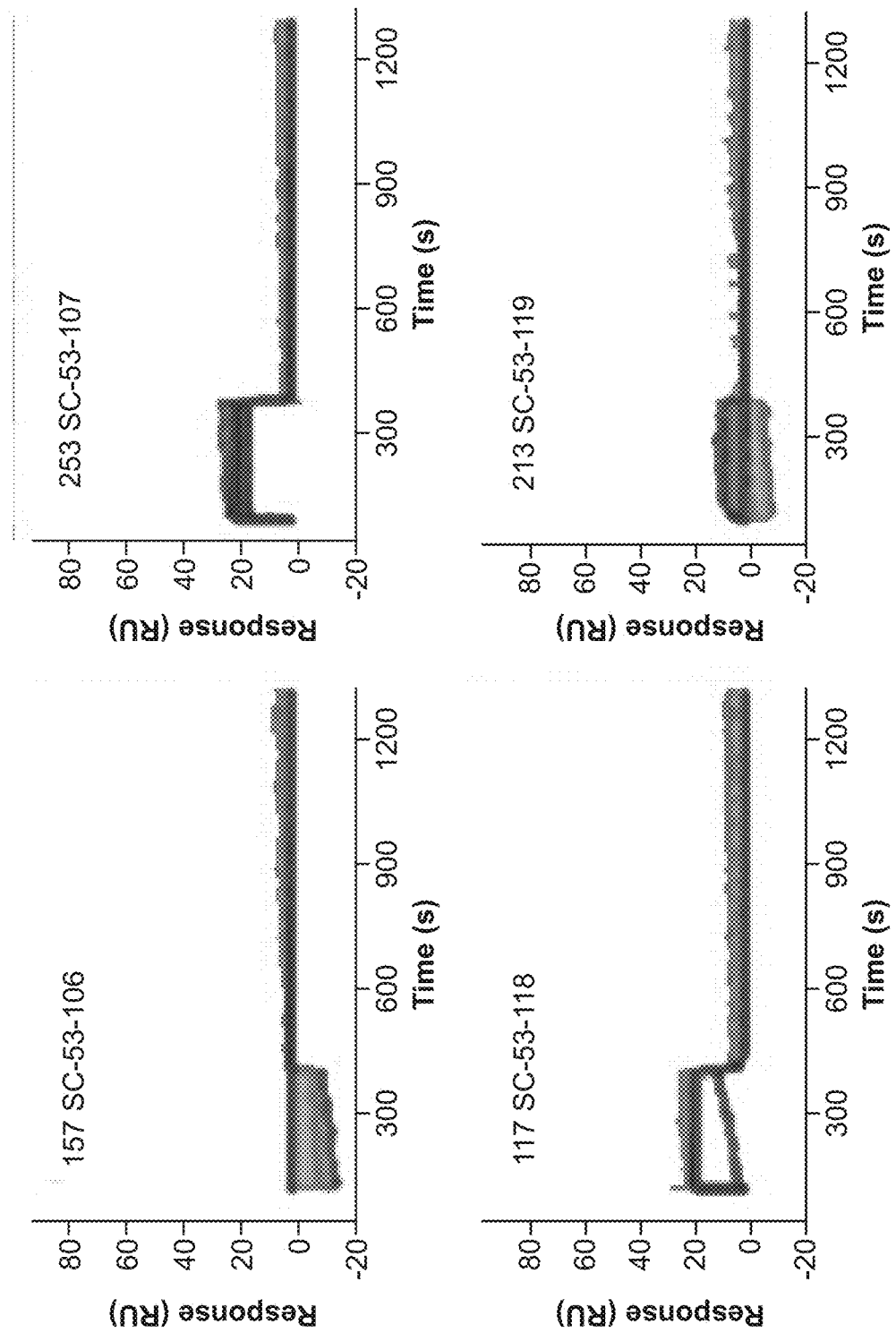
Figure 12C:
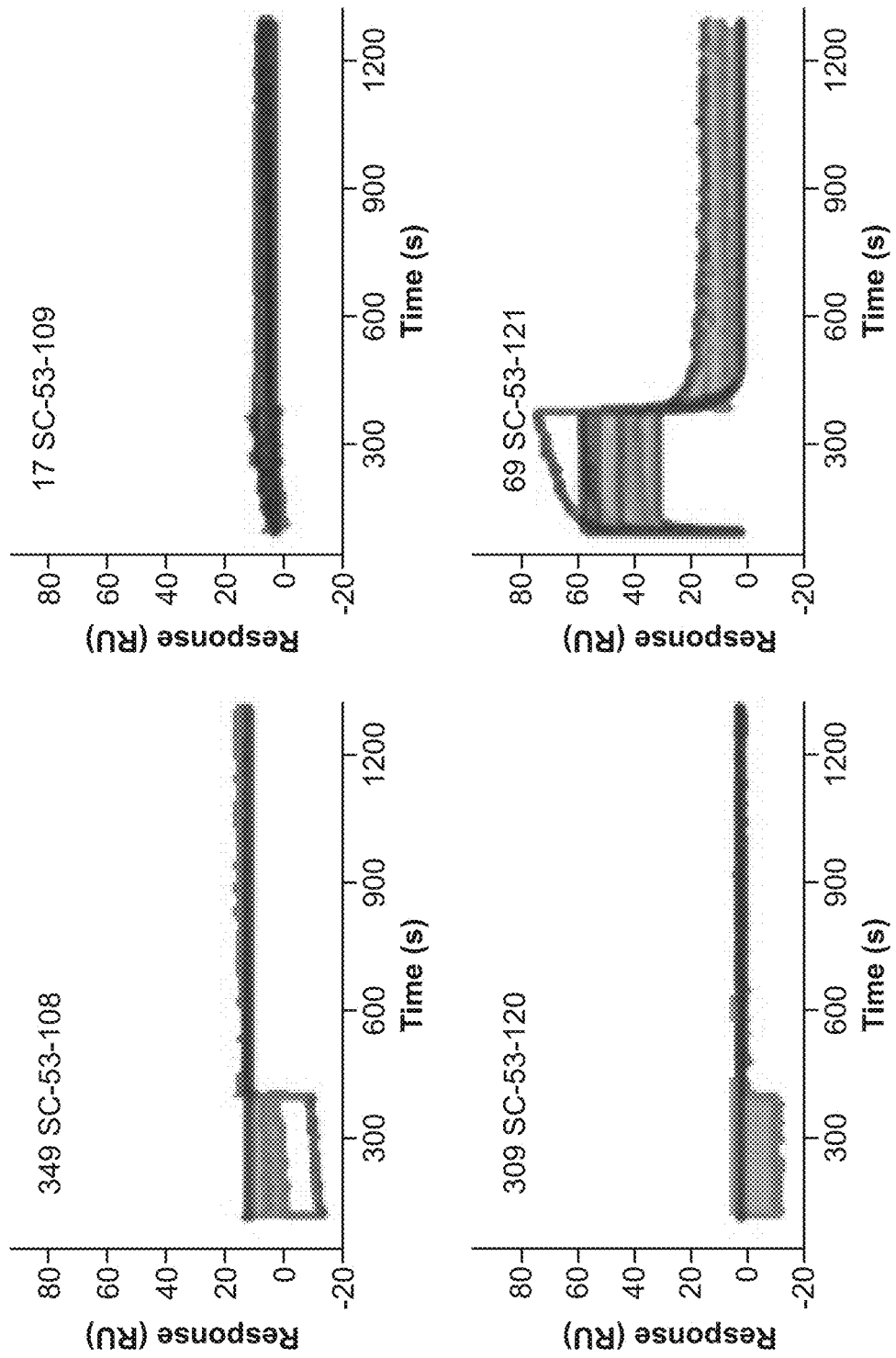
Figure 12C:
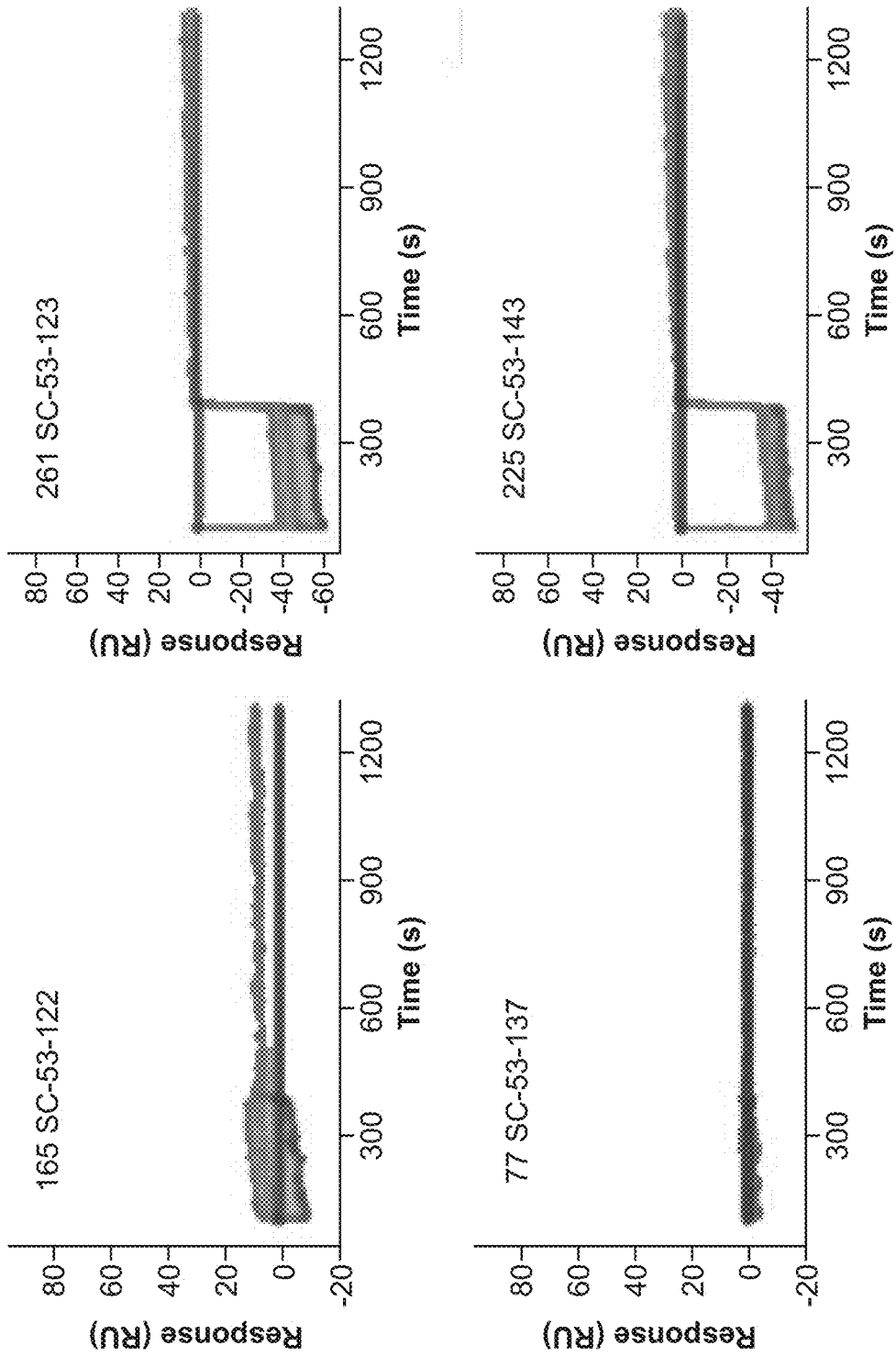
Figure 12C:
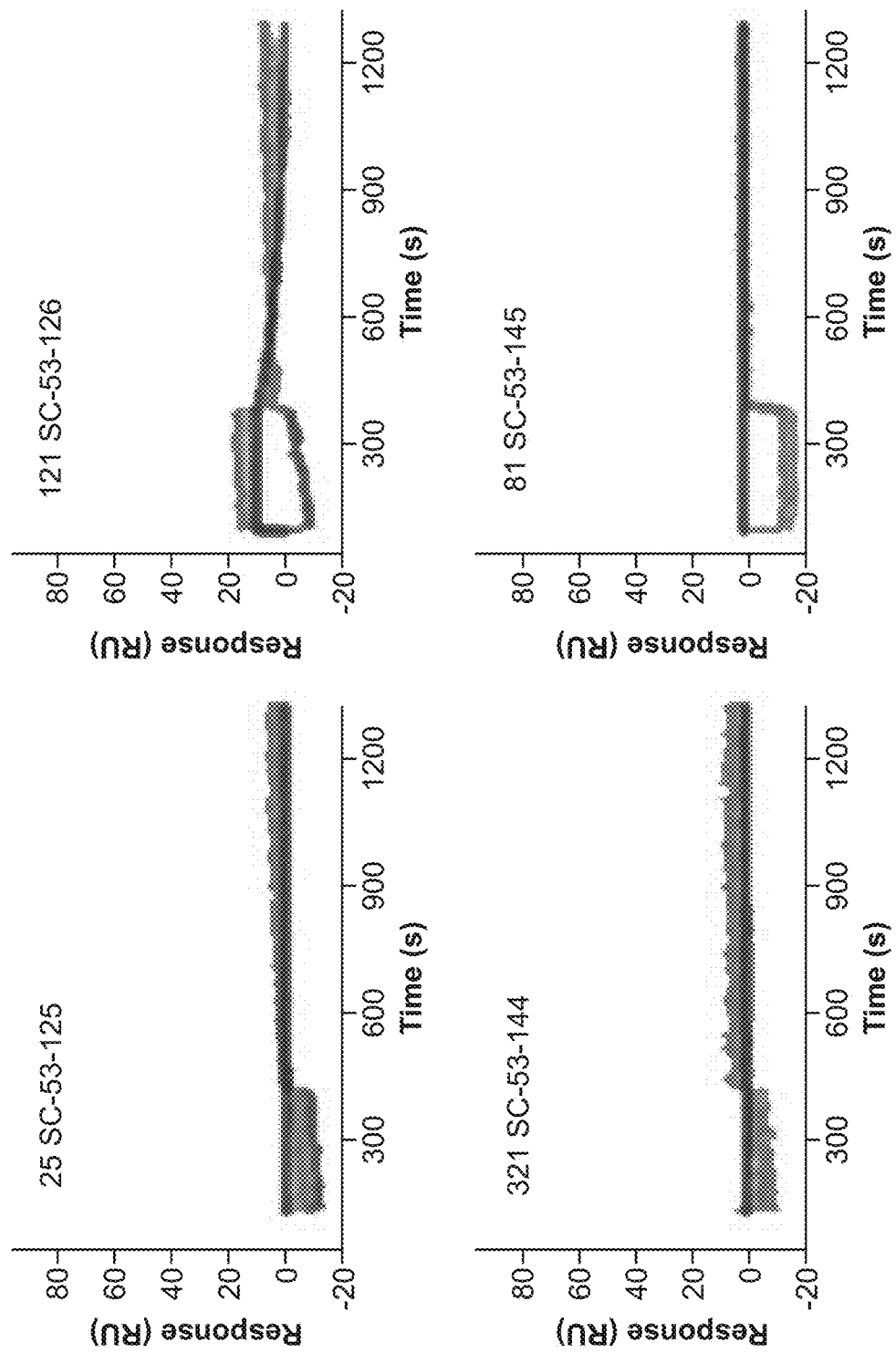
Figure 12C:
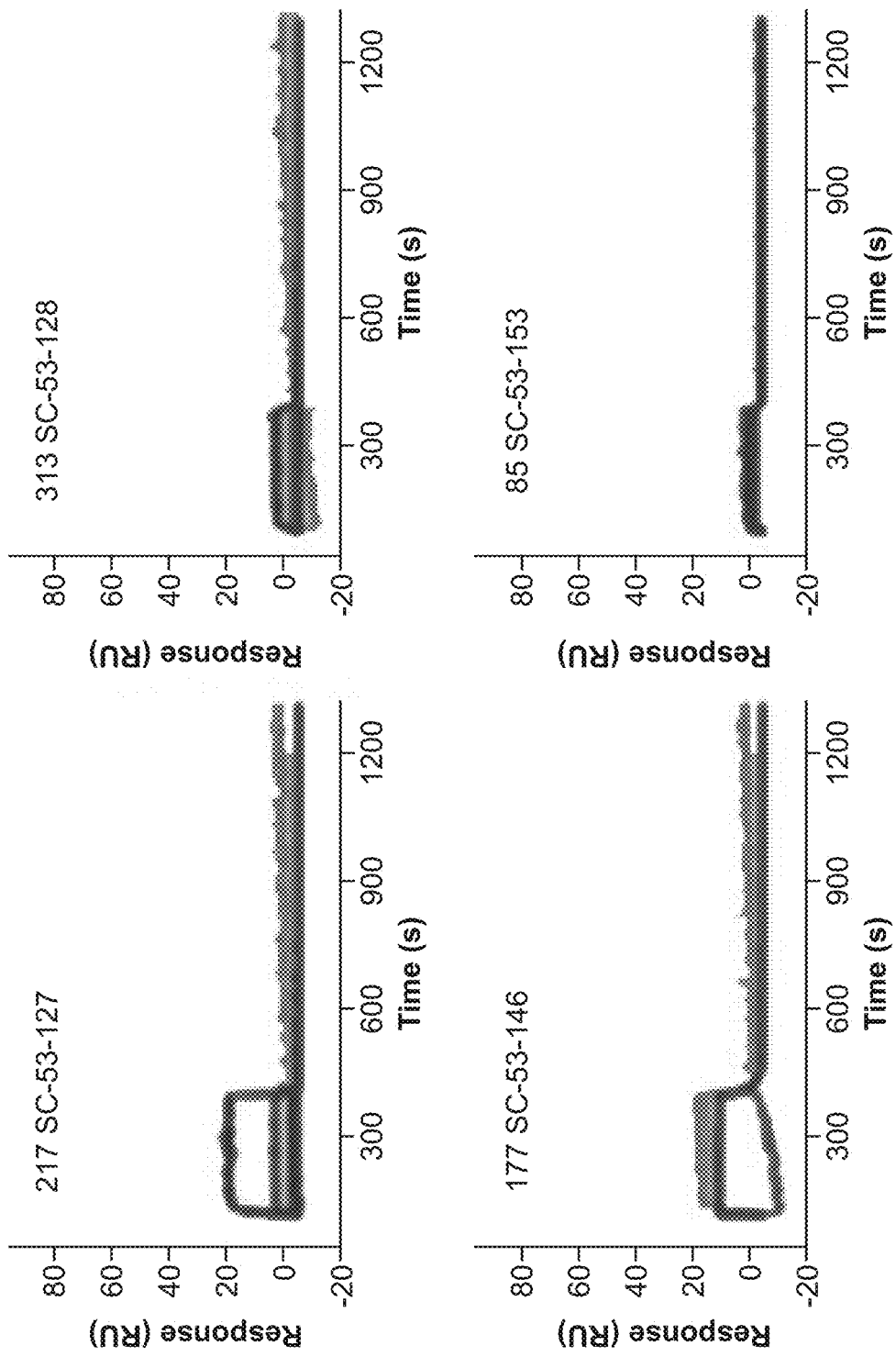
Figure 12C:
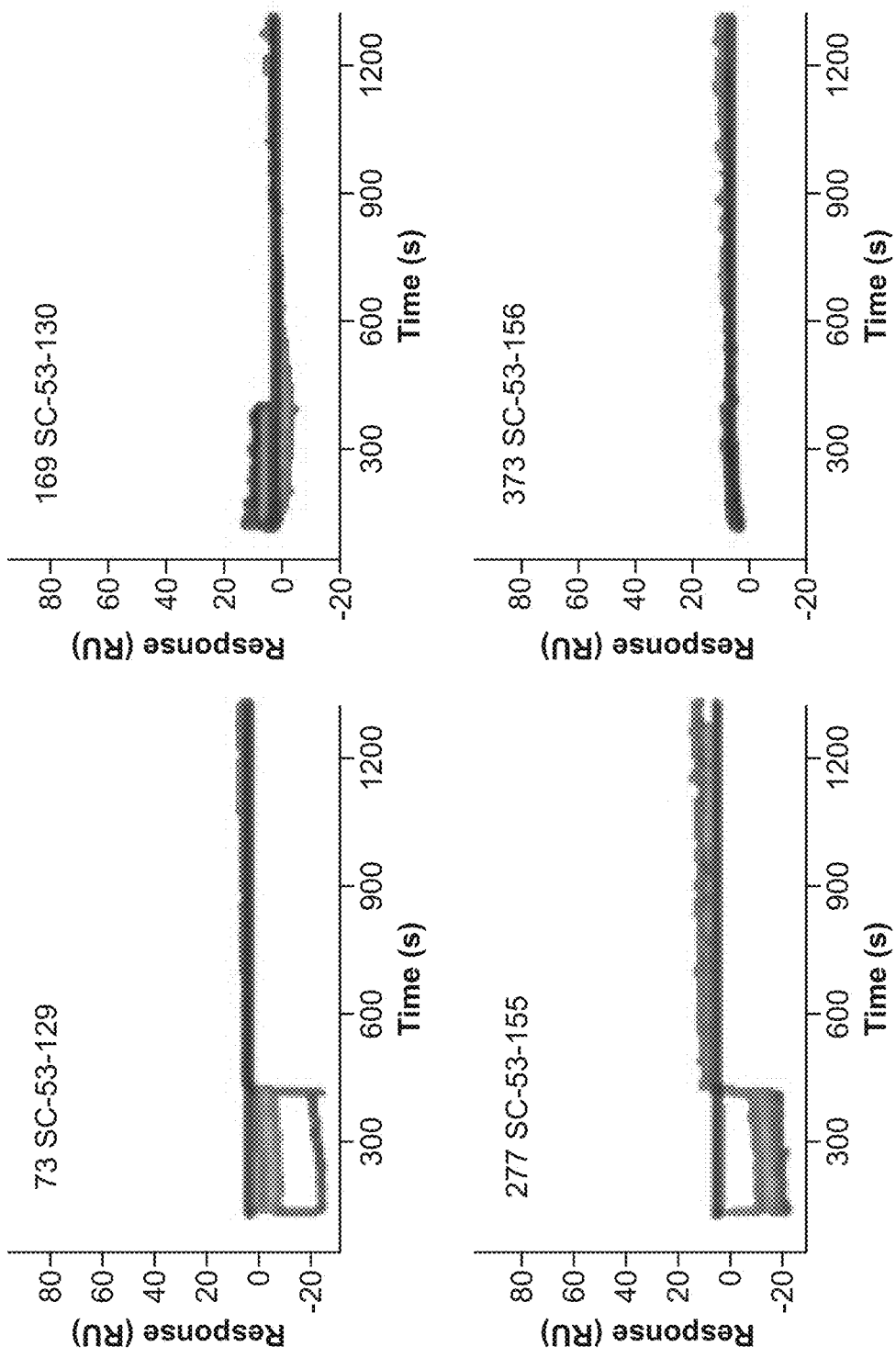
Figure 12C:
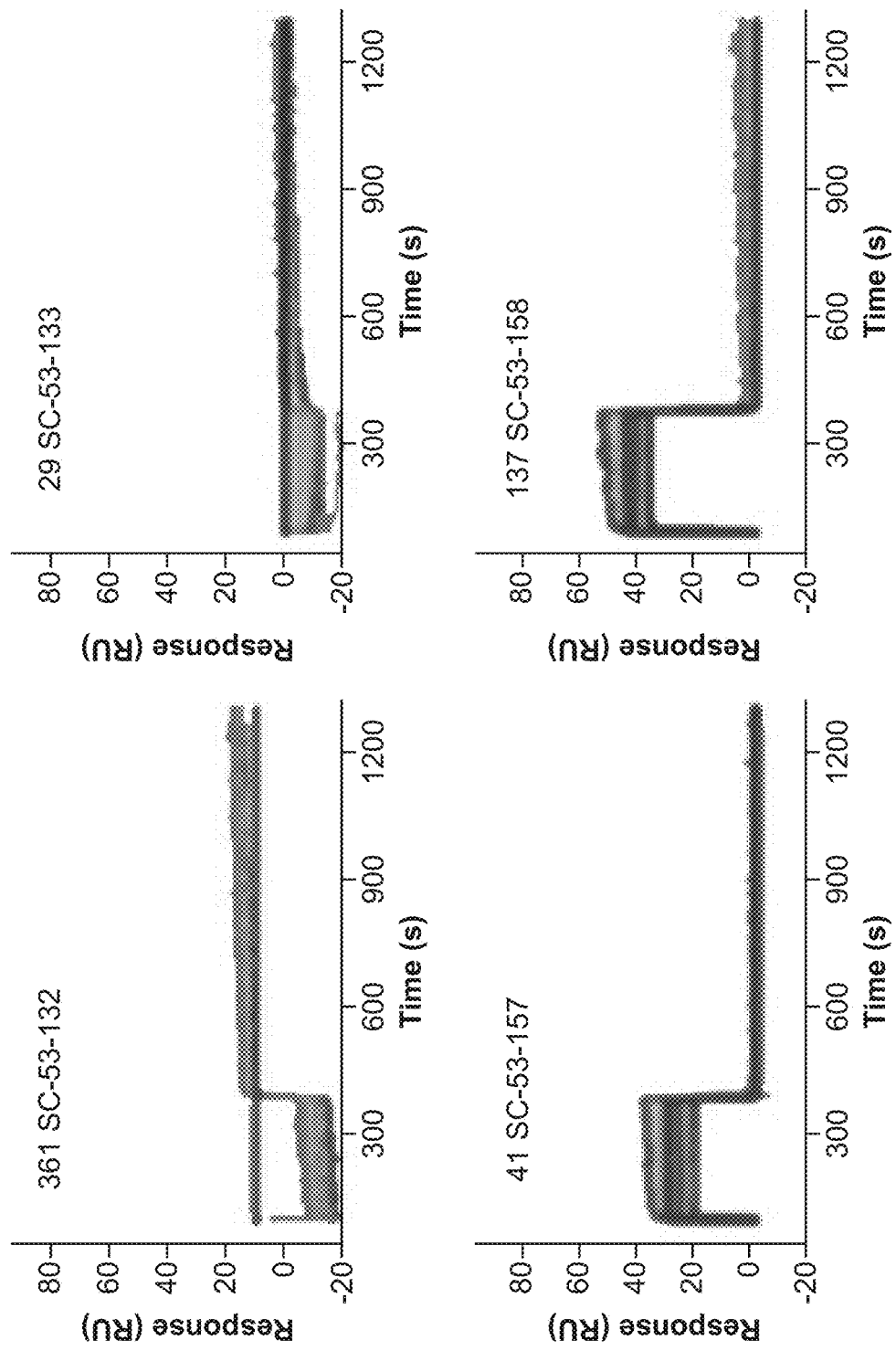
Figure 12C:
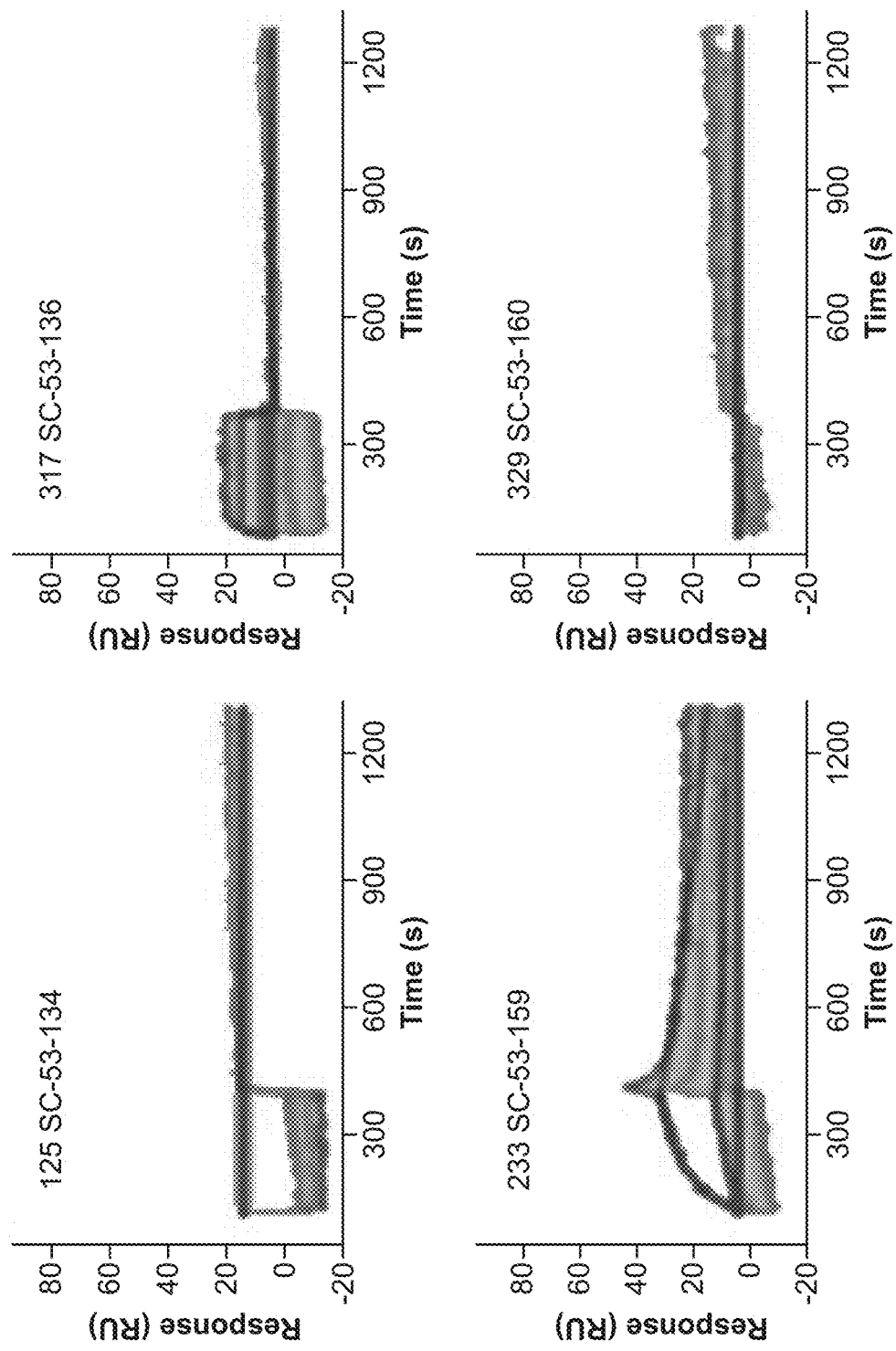
Figure 12C:
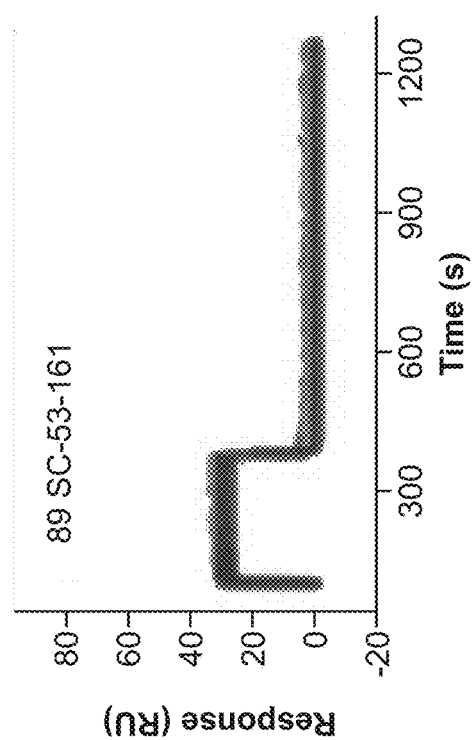
Figure 12D:
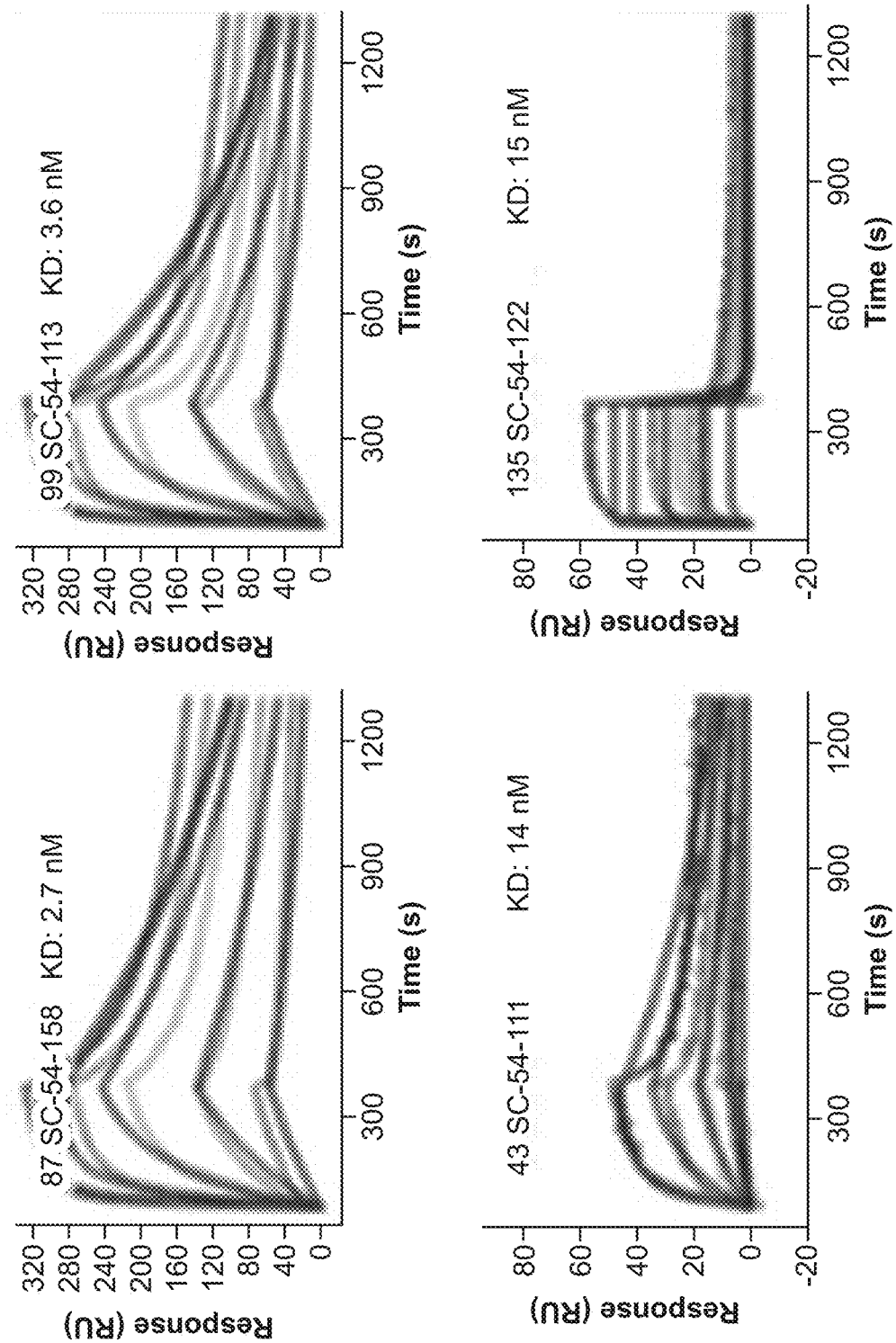
FIG. 12D depicts additional Carterra SPR kinetic graphs showing VHH-Fc hits identified from NGS sequencing binding with high affinity to DKK1.
Figure 12D:
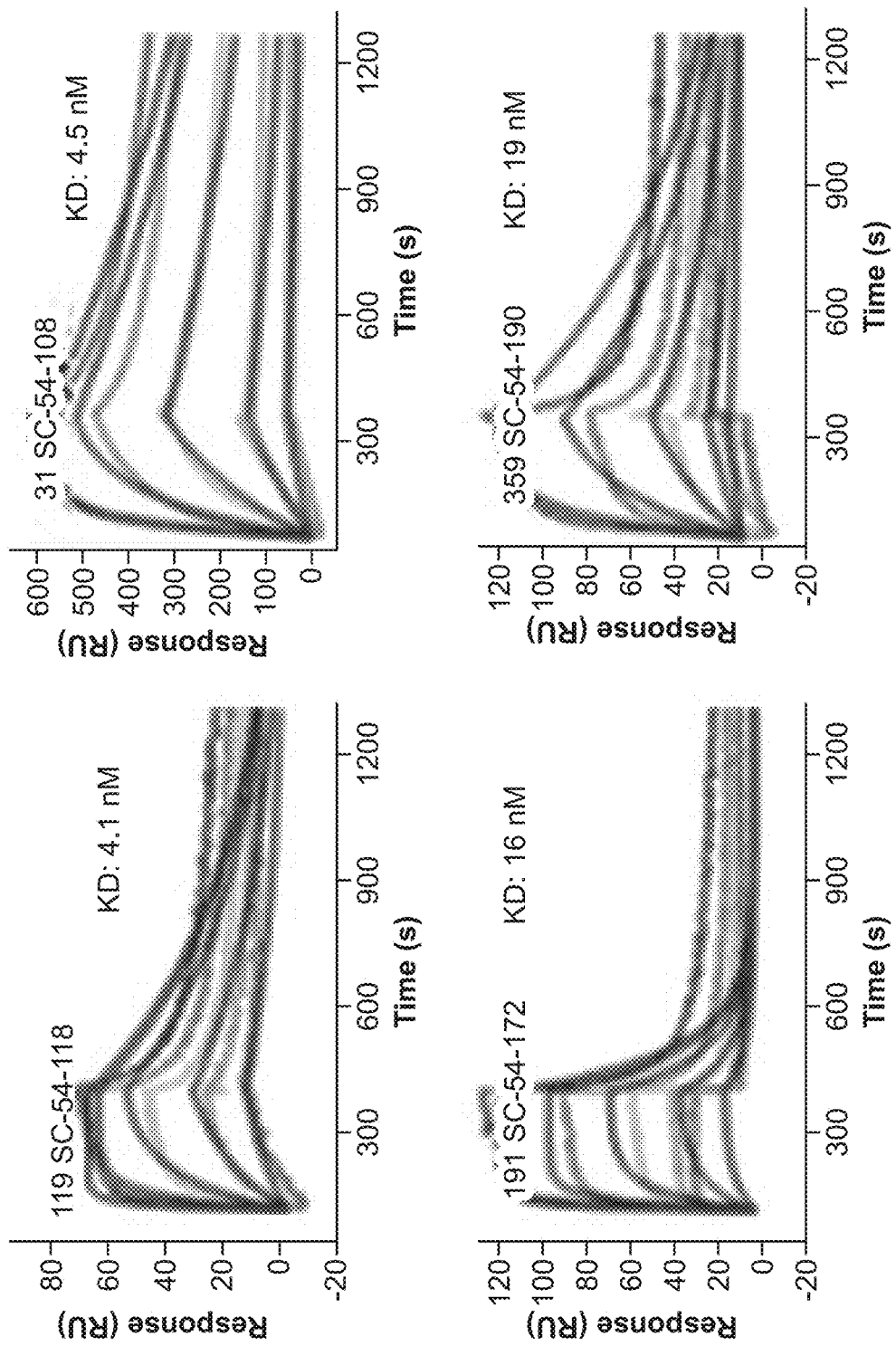
Figure 12D:
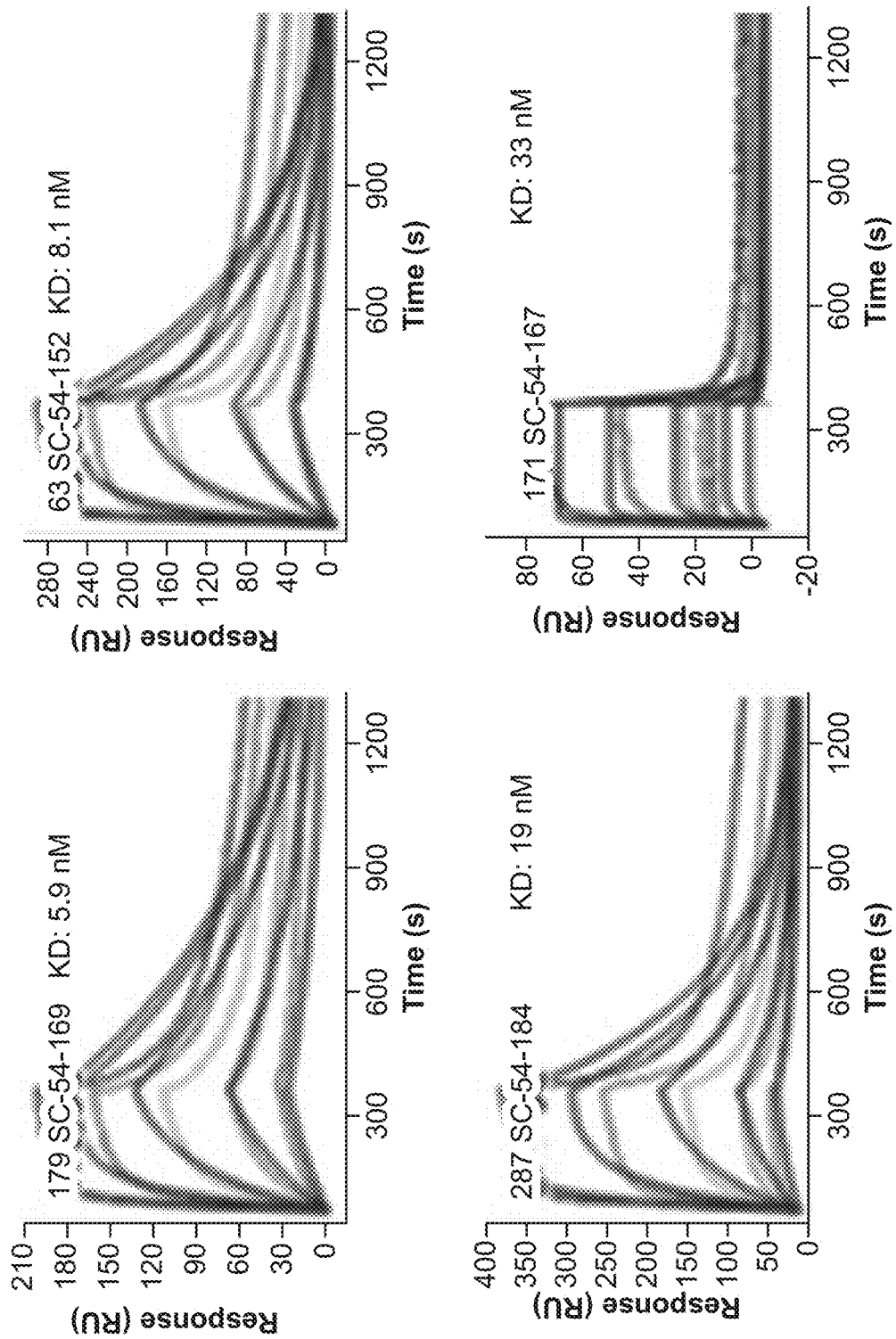
Figure 12D:
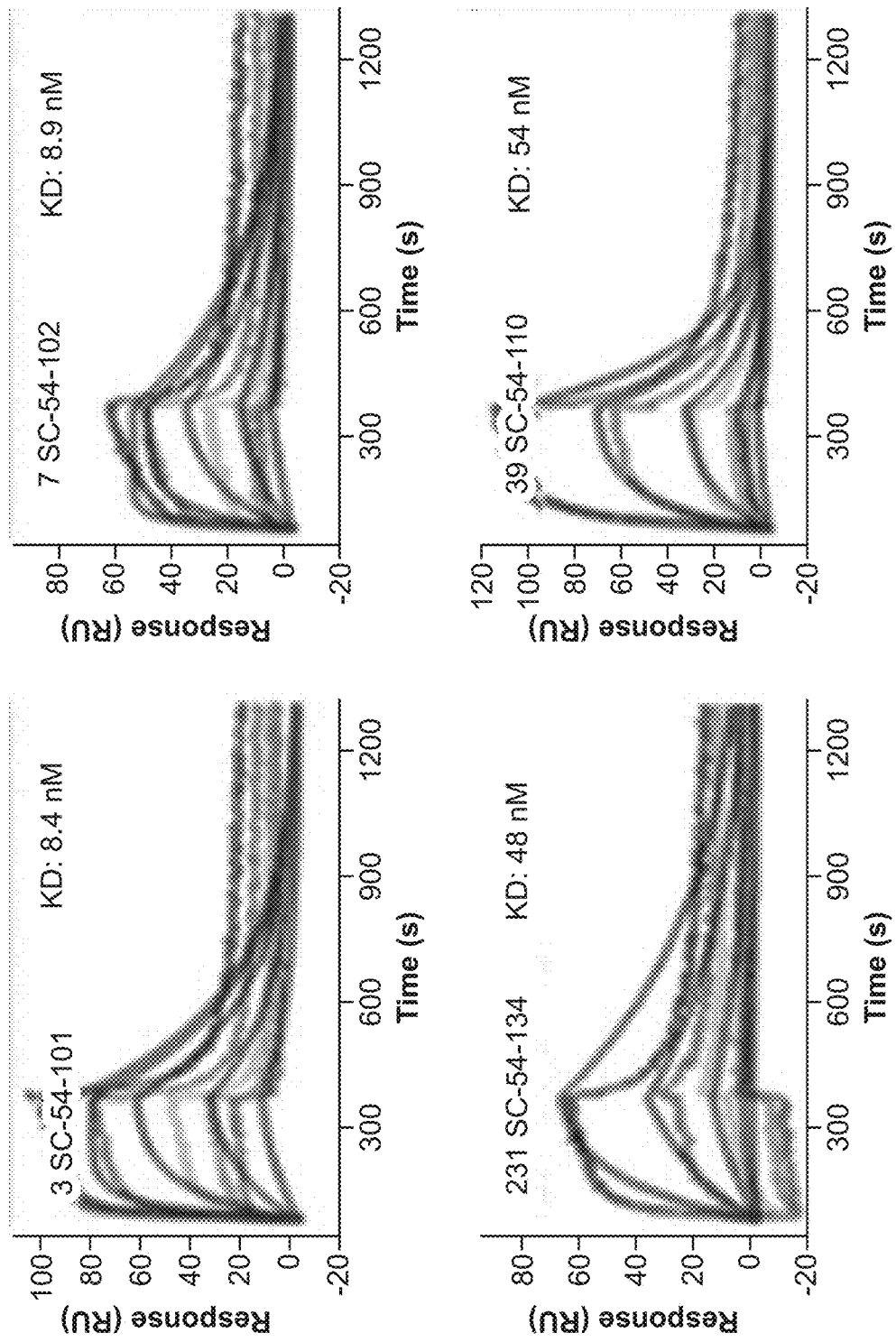
Figure 12D:
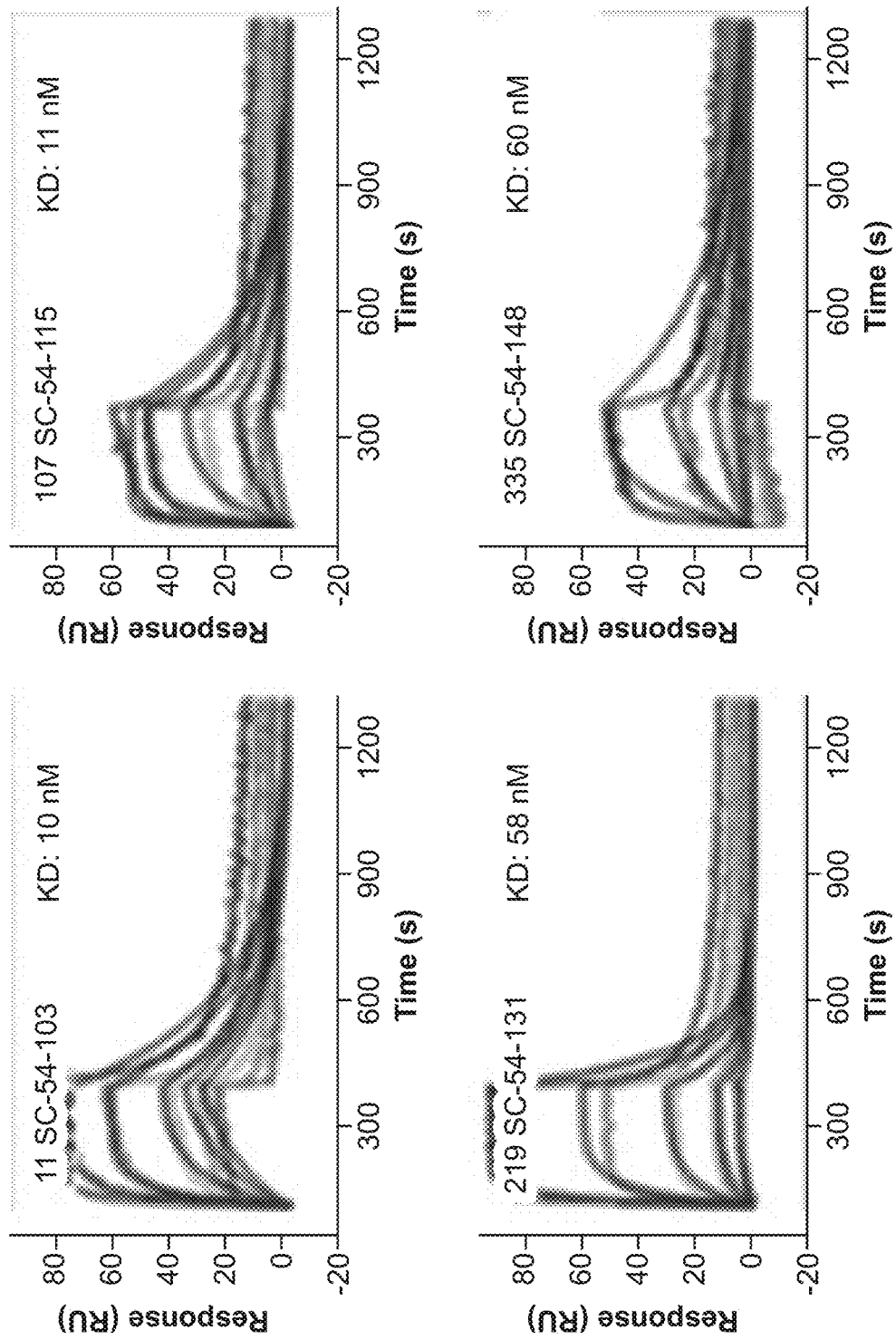
Figure 12D:
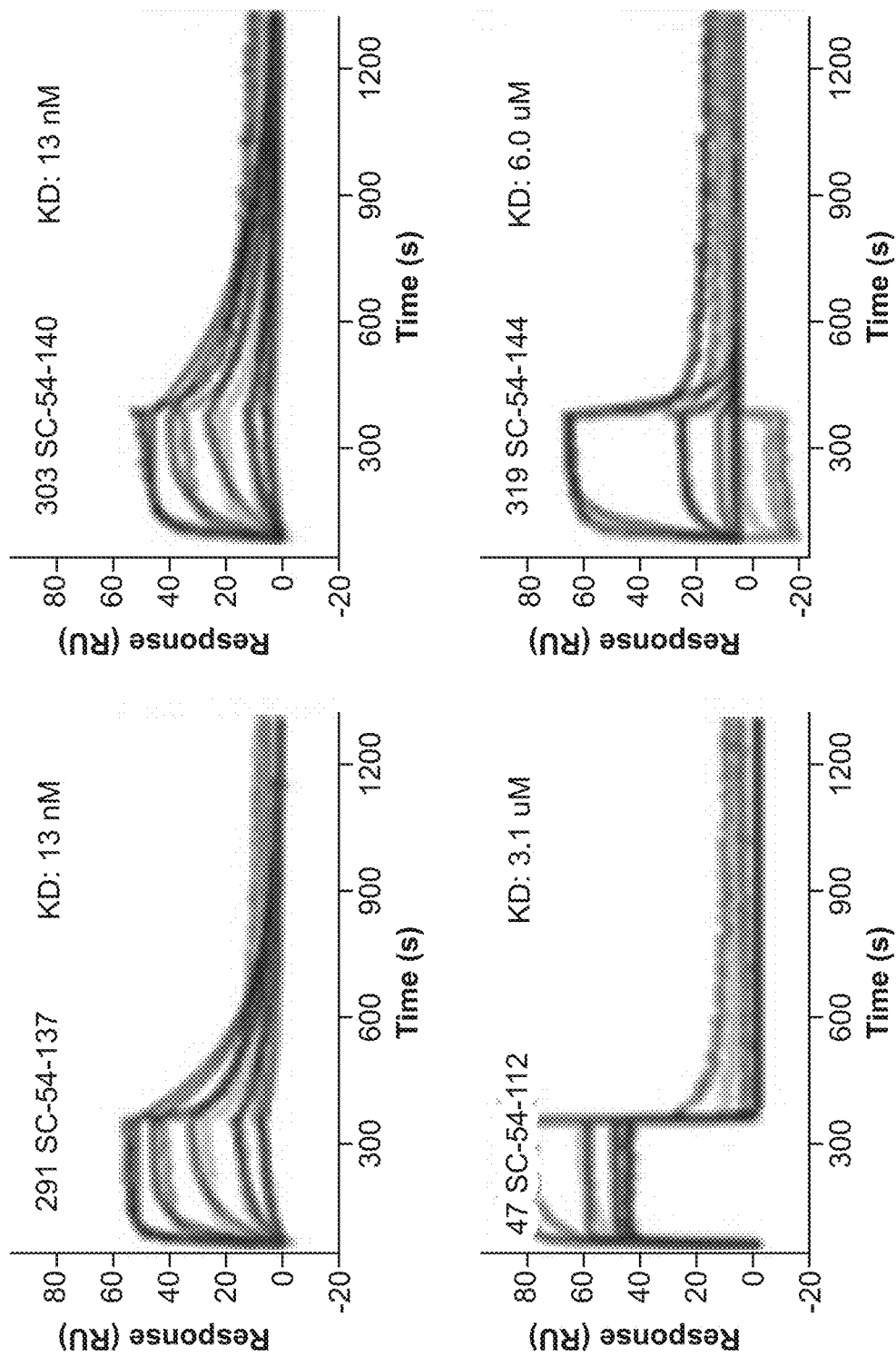
Figure 12D:
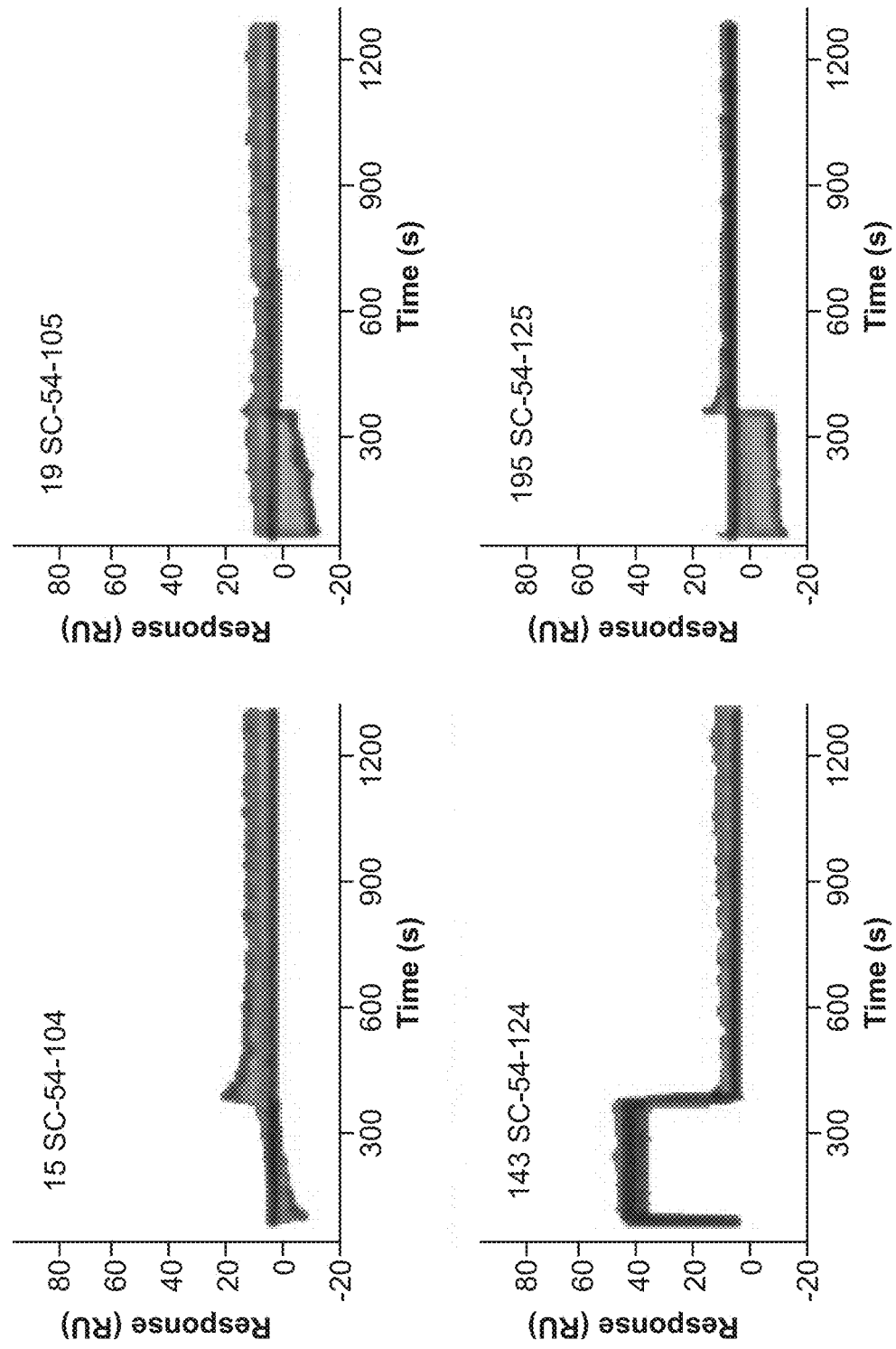
Figure 12D:
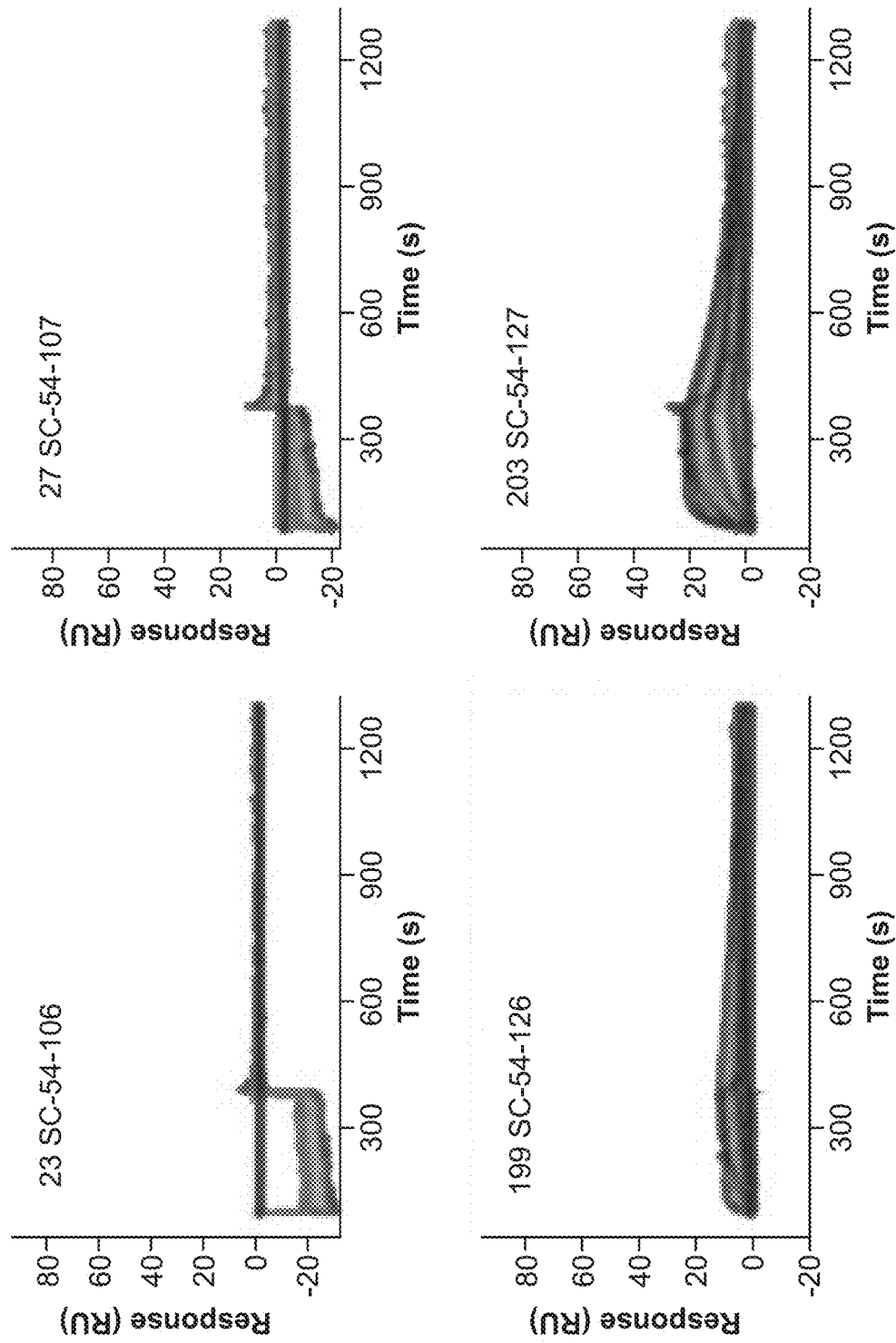
Figure 12D:
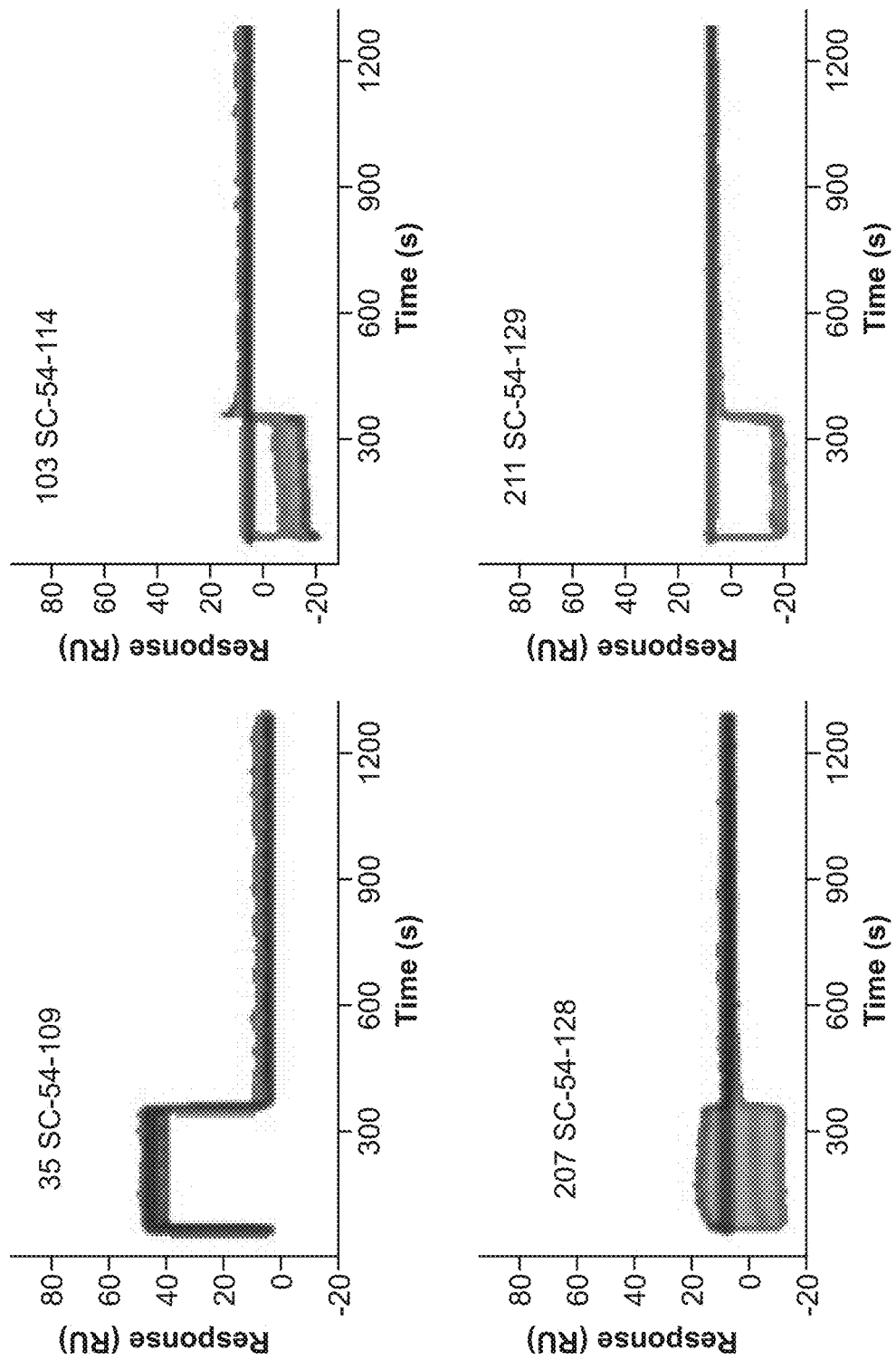
Figure 12D:
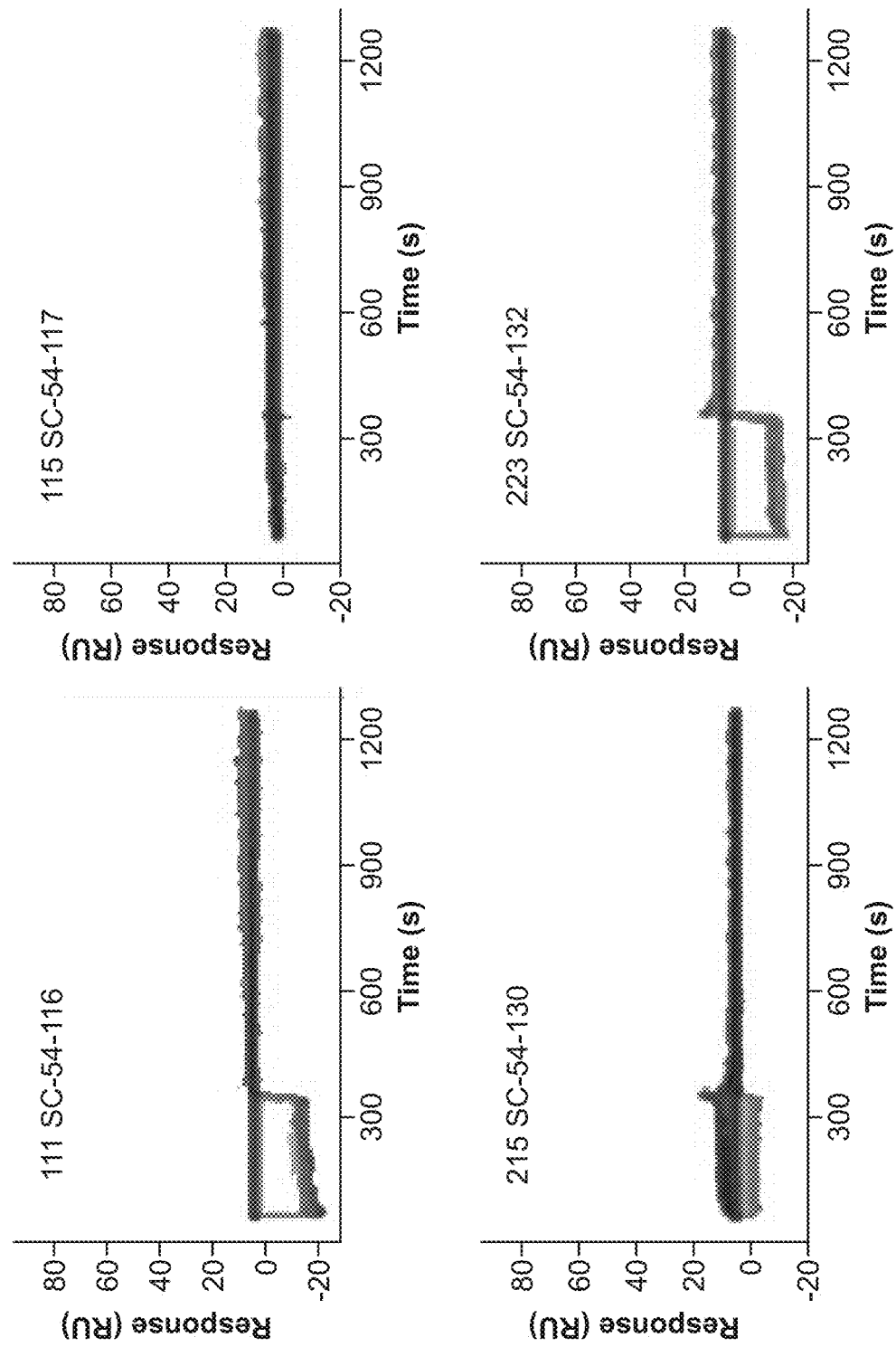
Figure 12D:
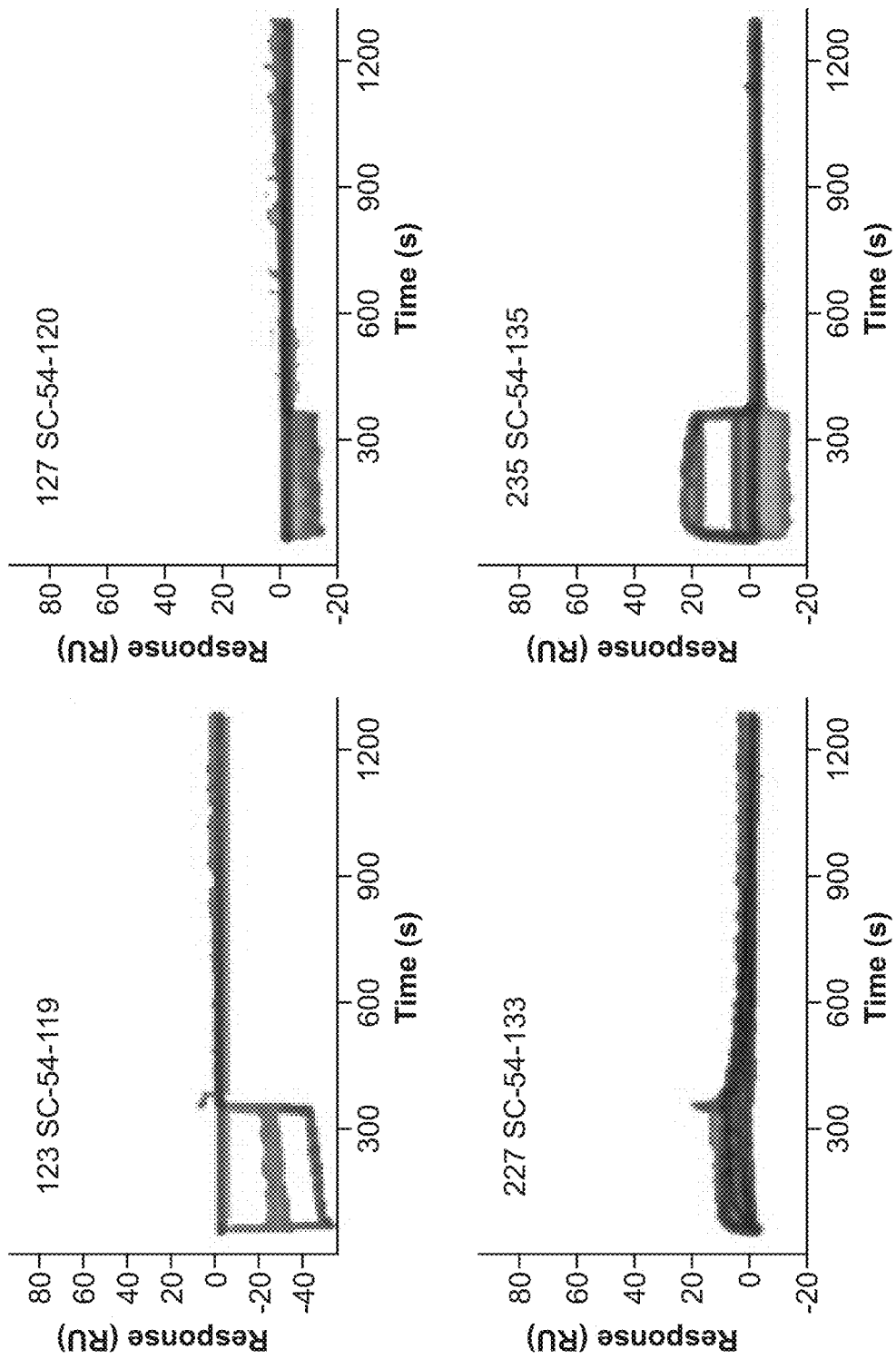
Figure 12D:
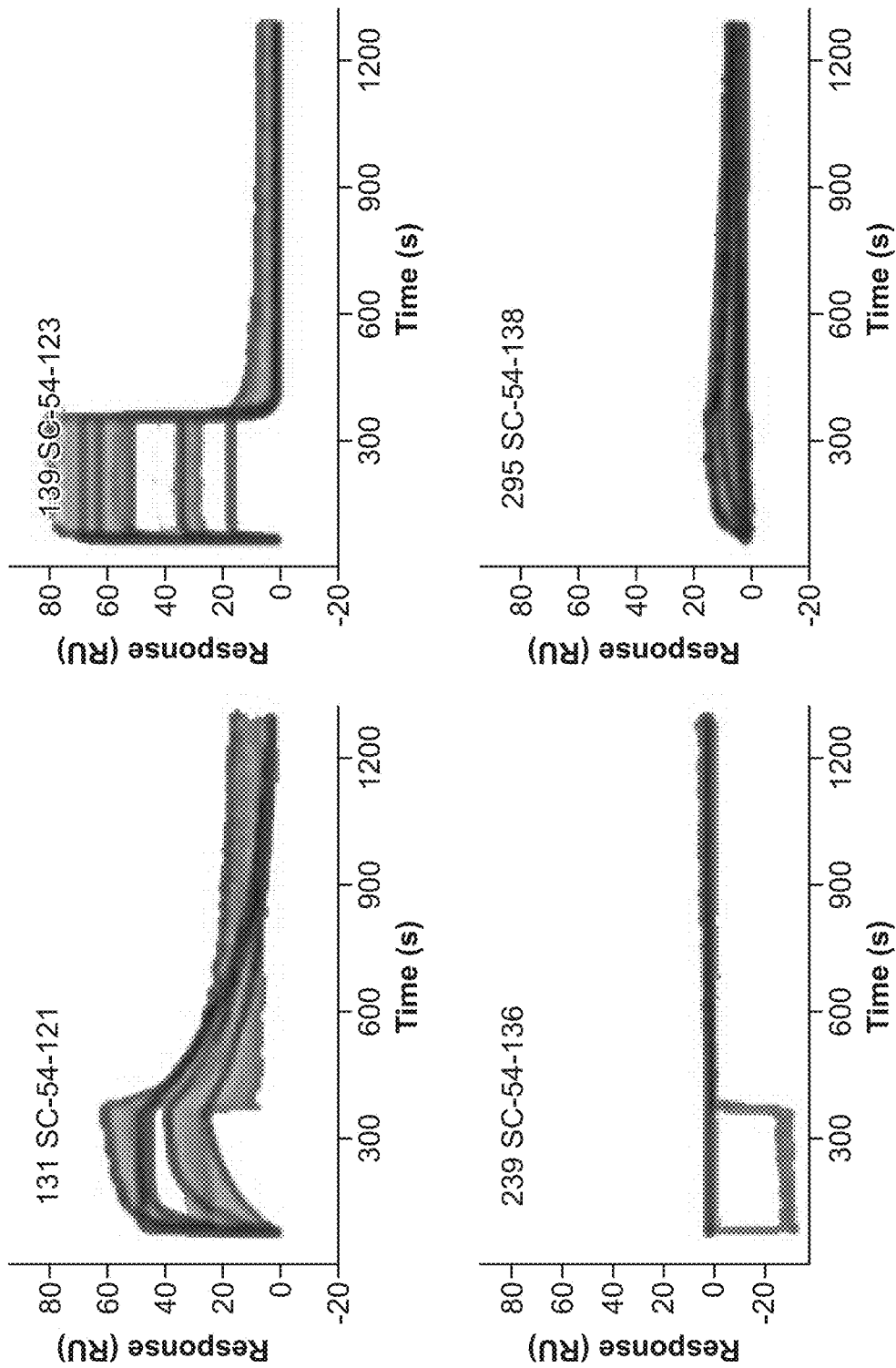
Figure 12D:
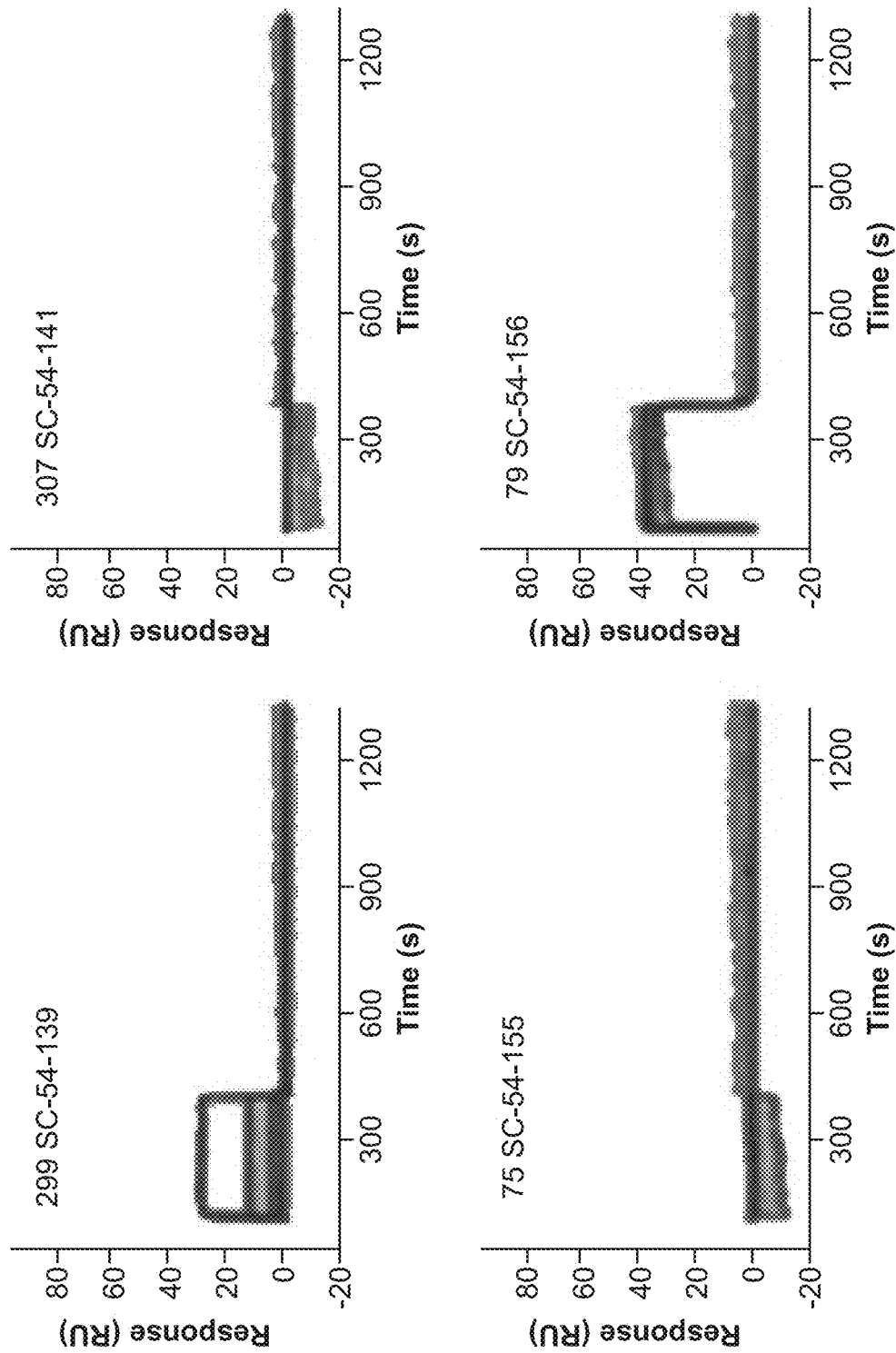
Figure 12D:
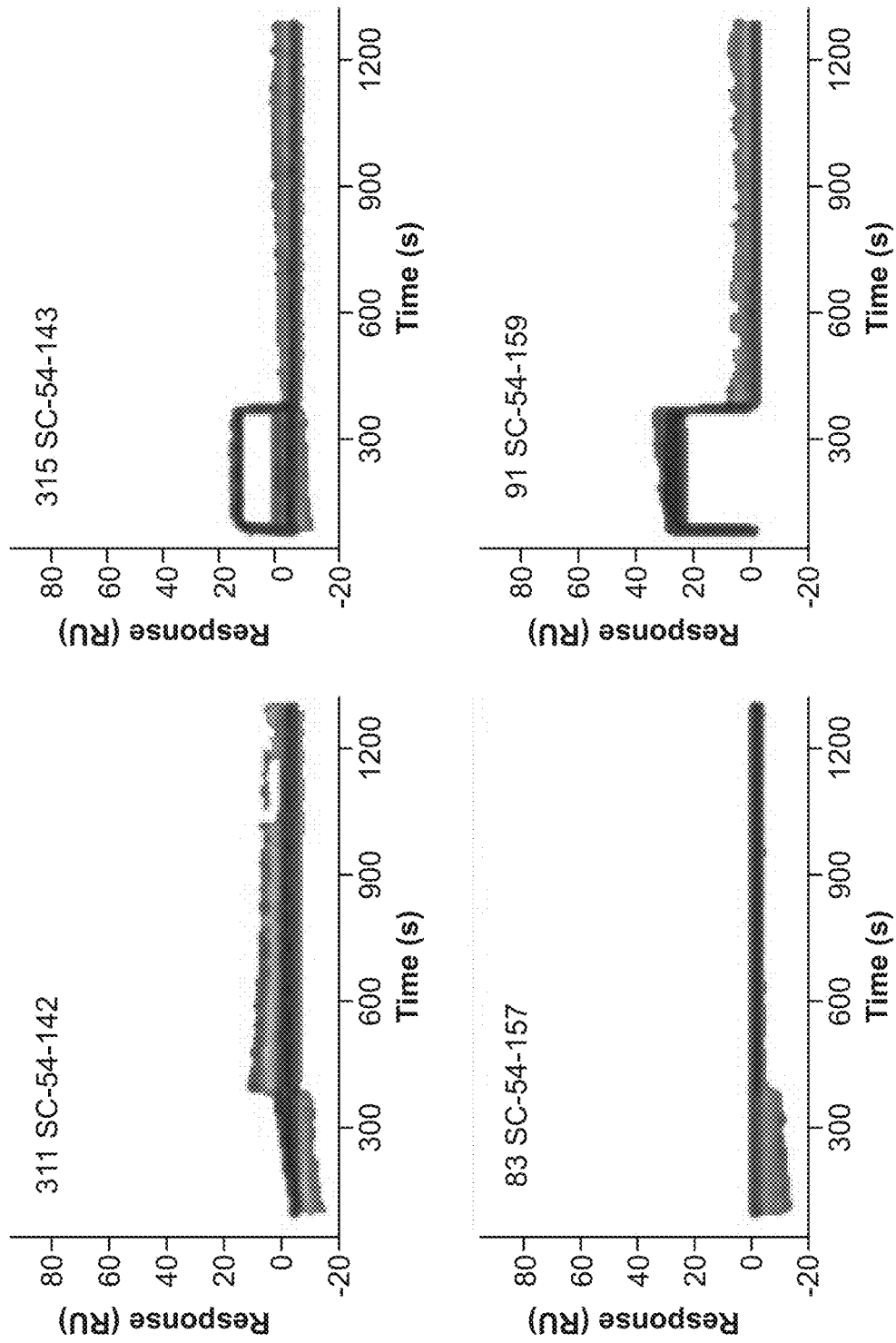
Figure 12D:
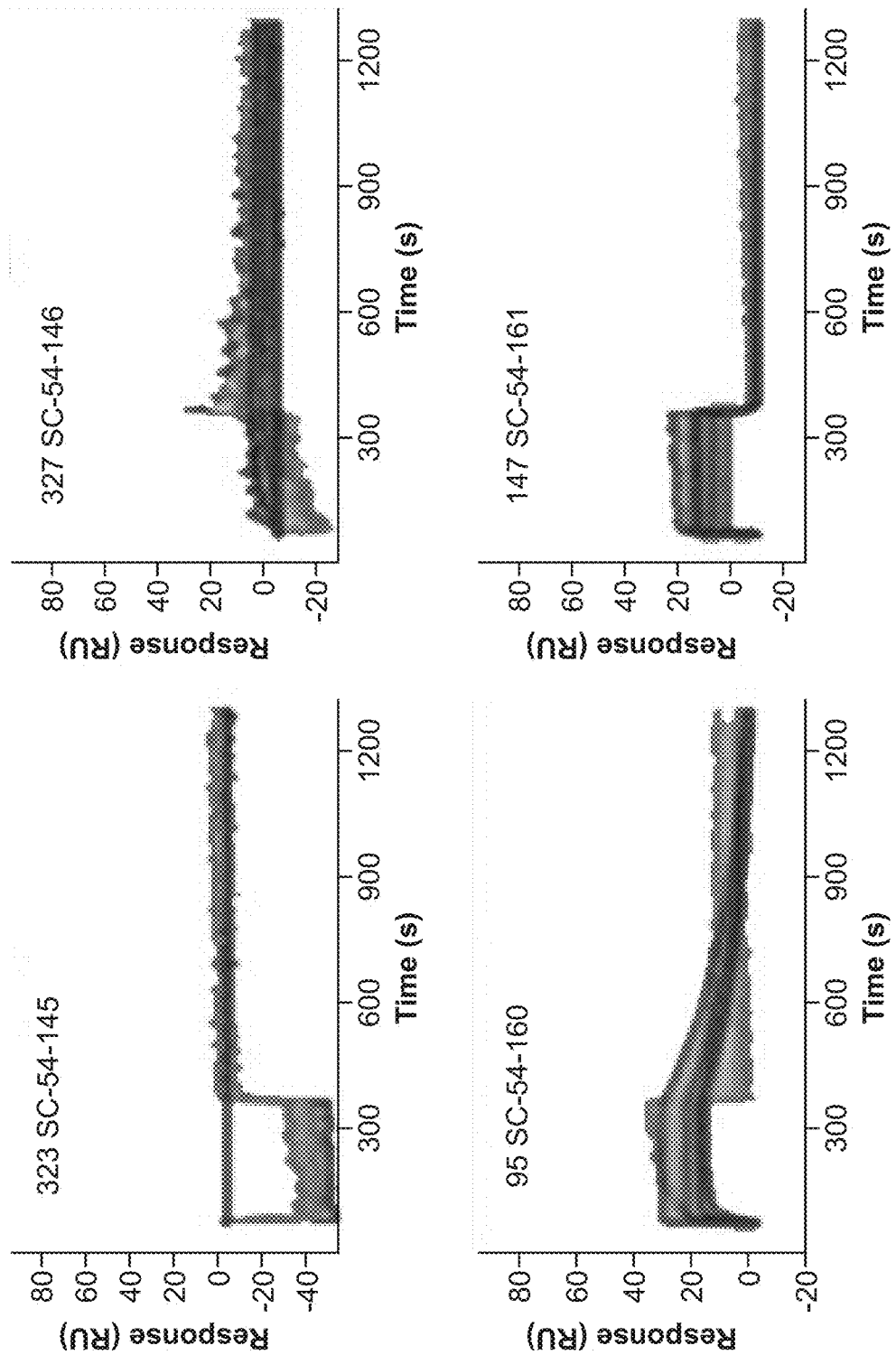
Figure 12D:
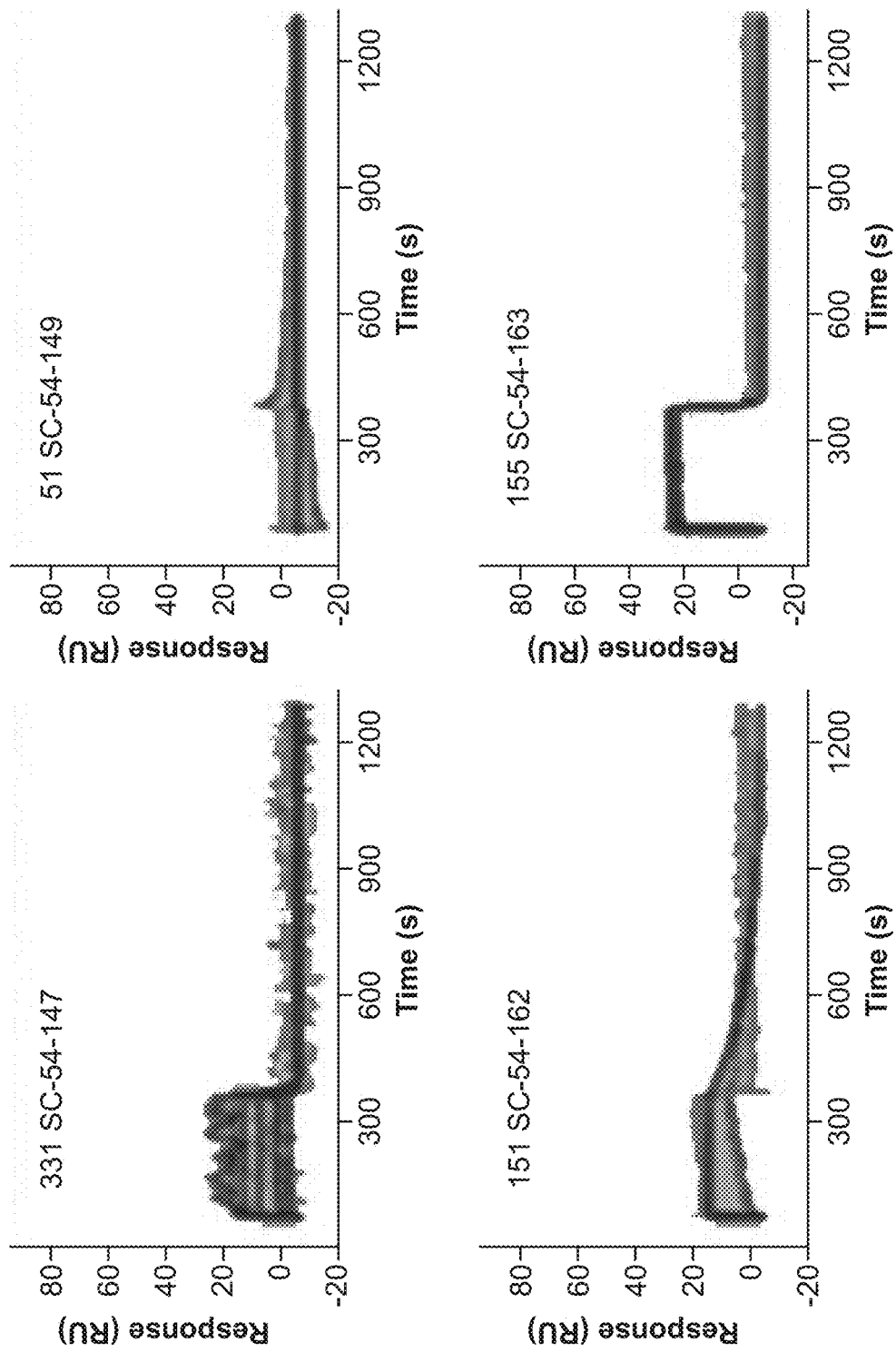
Figure 12D:
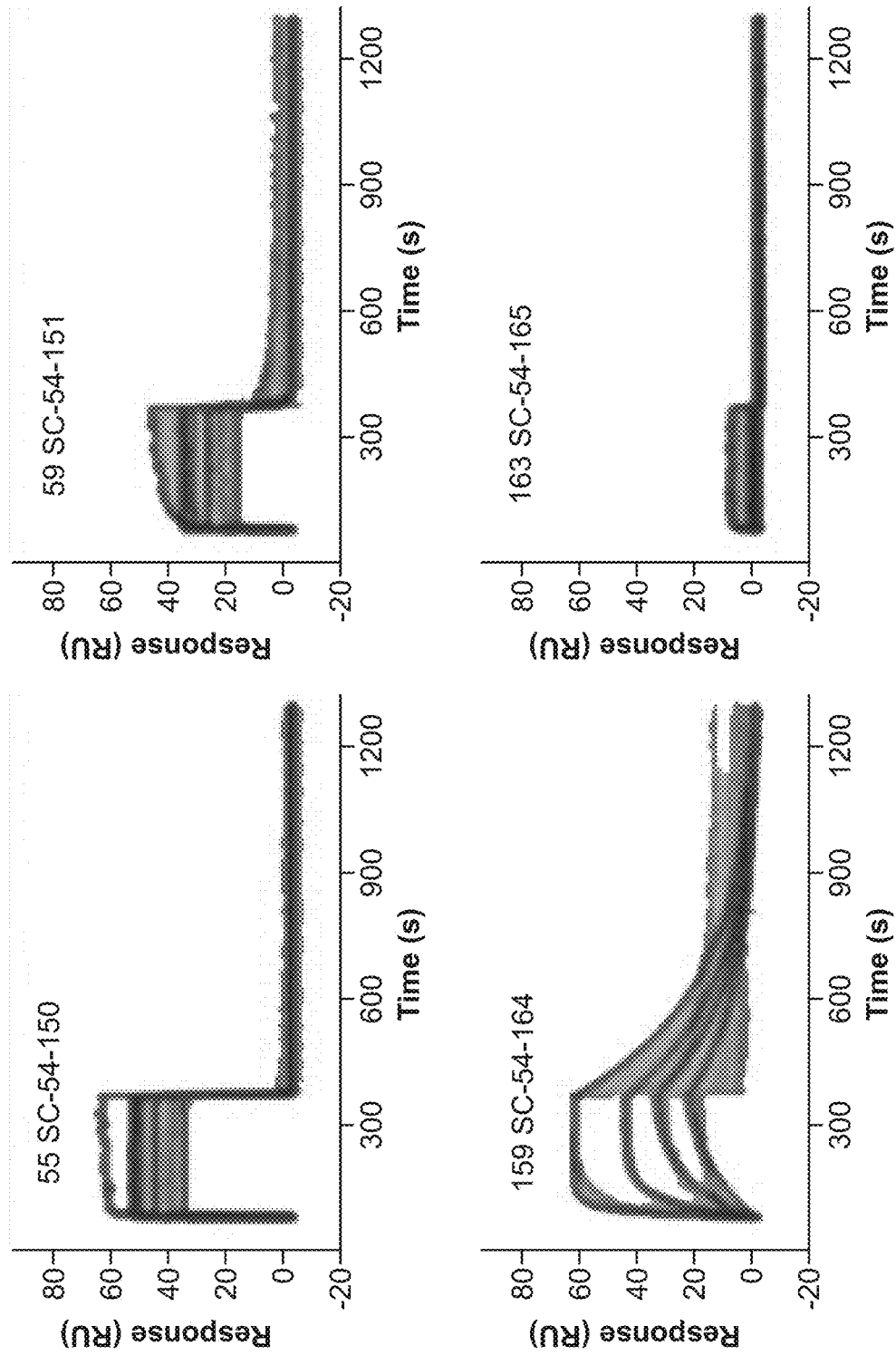
Figure 12D:
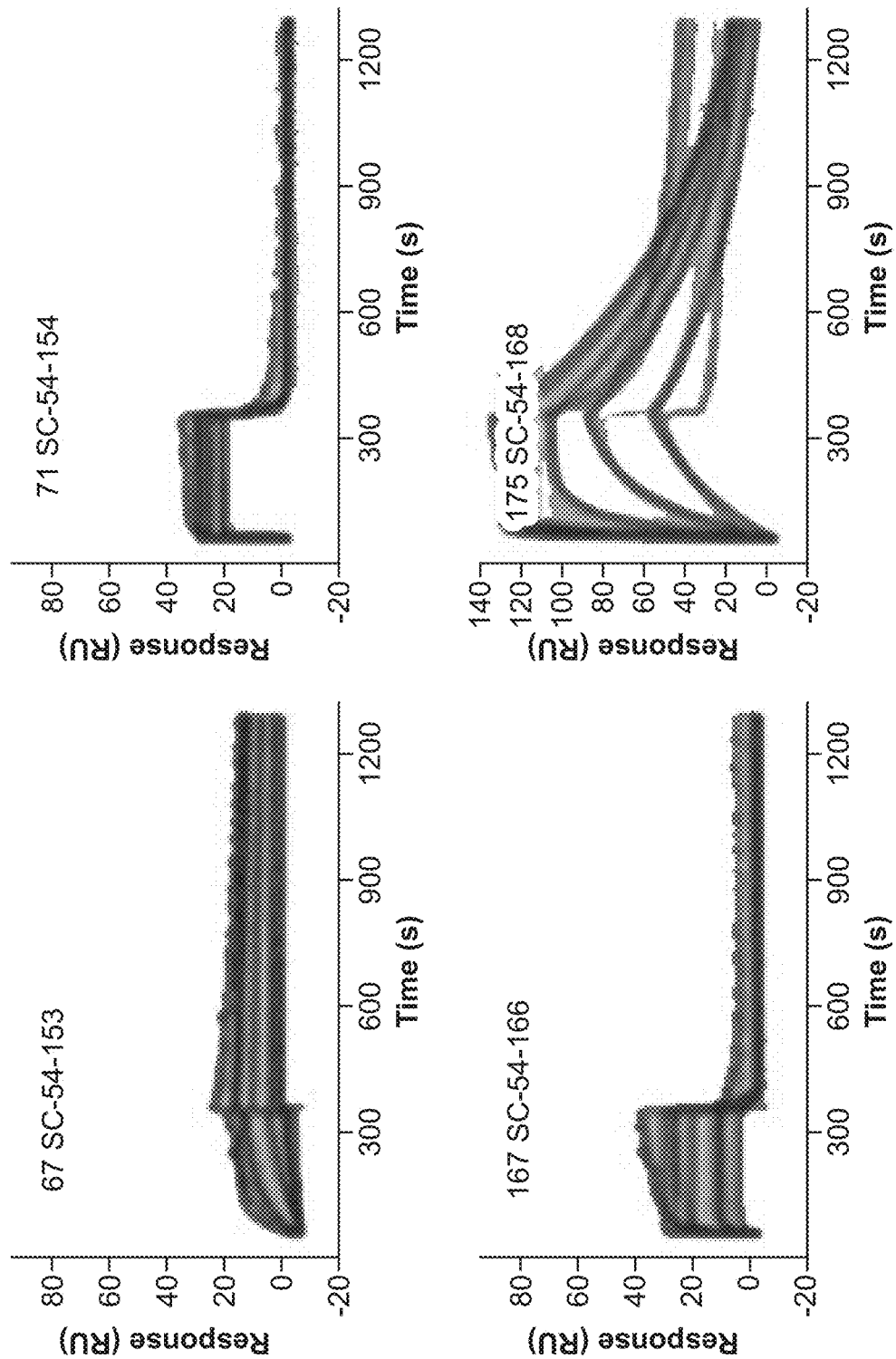
Figure 12D:
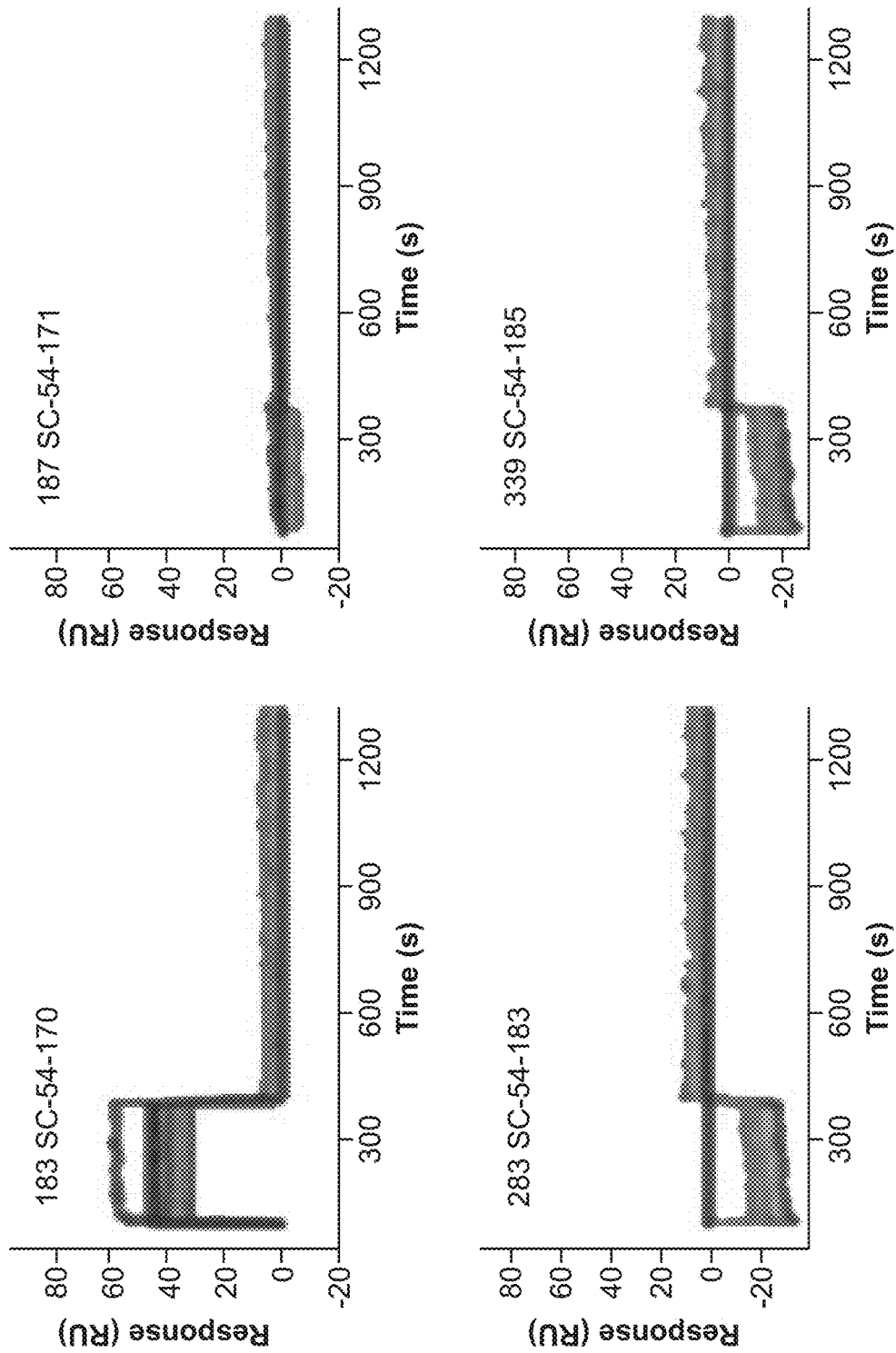
Figure 12D:
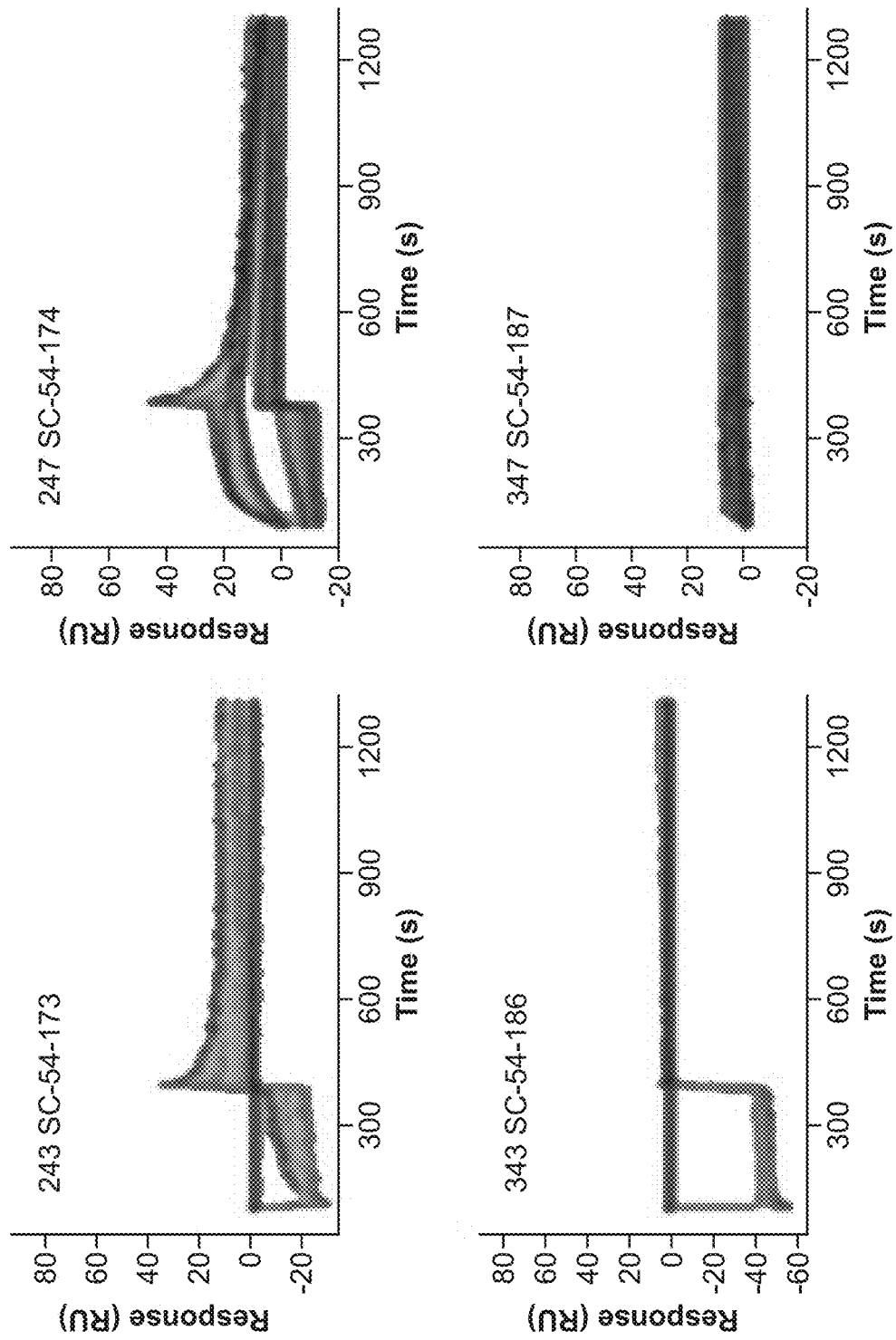
Figure 12D:
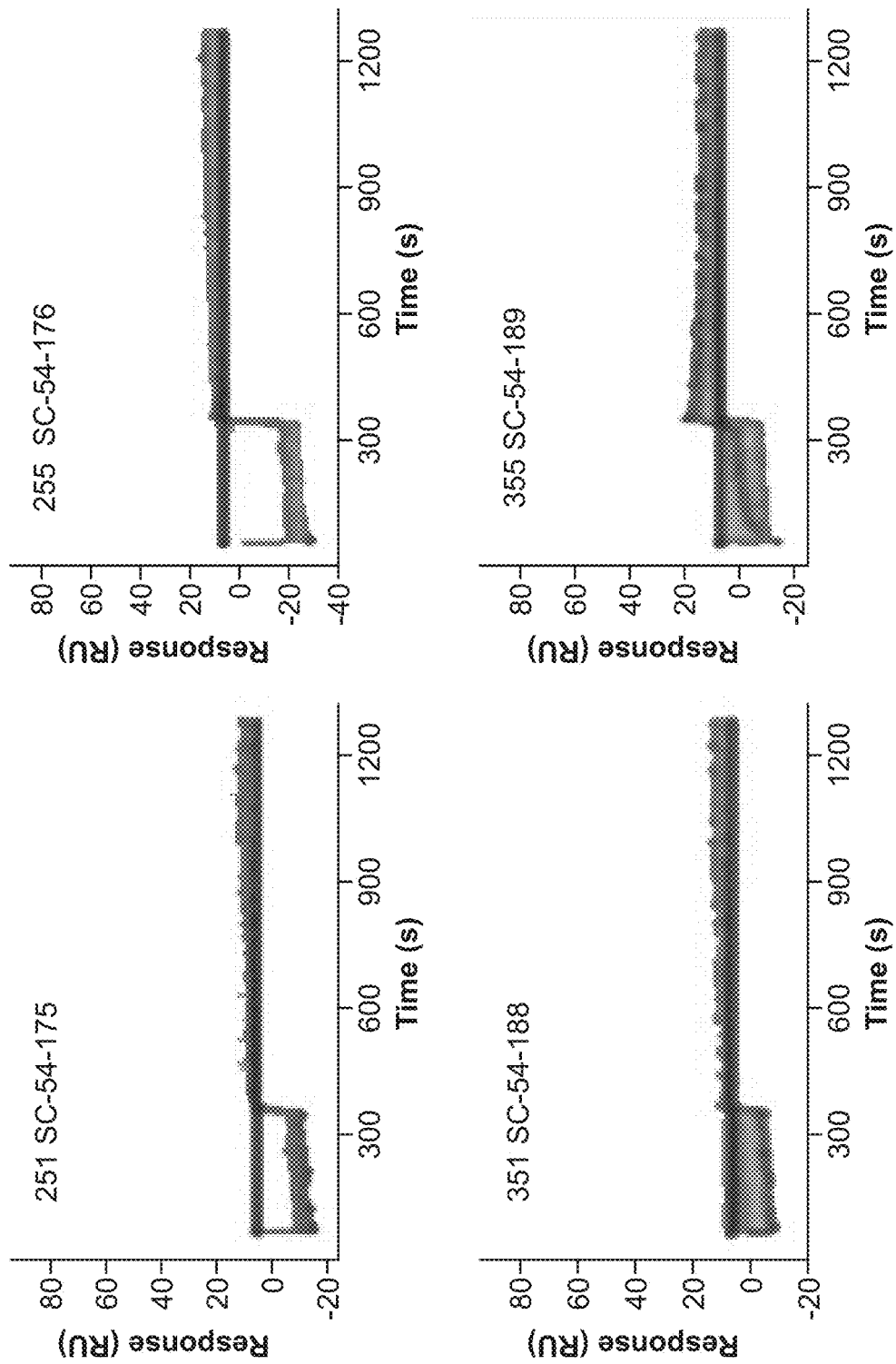
Figure 12D:
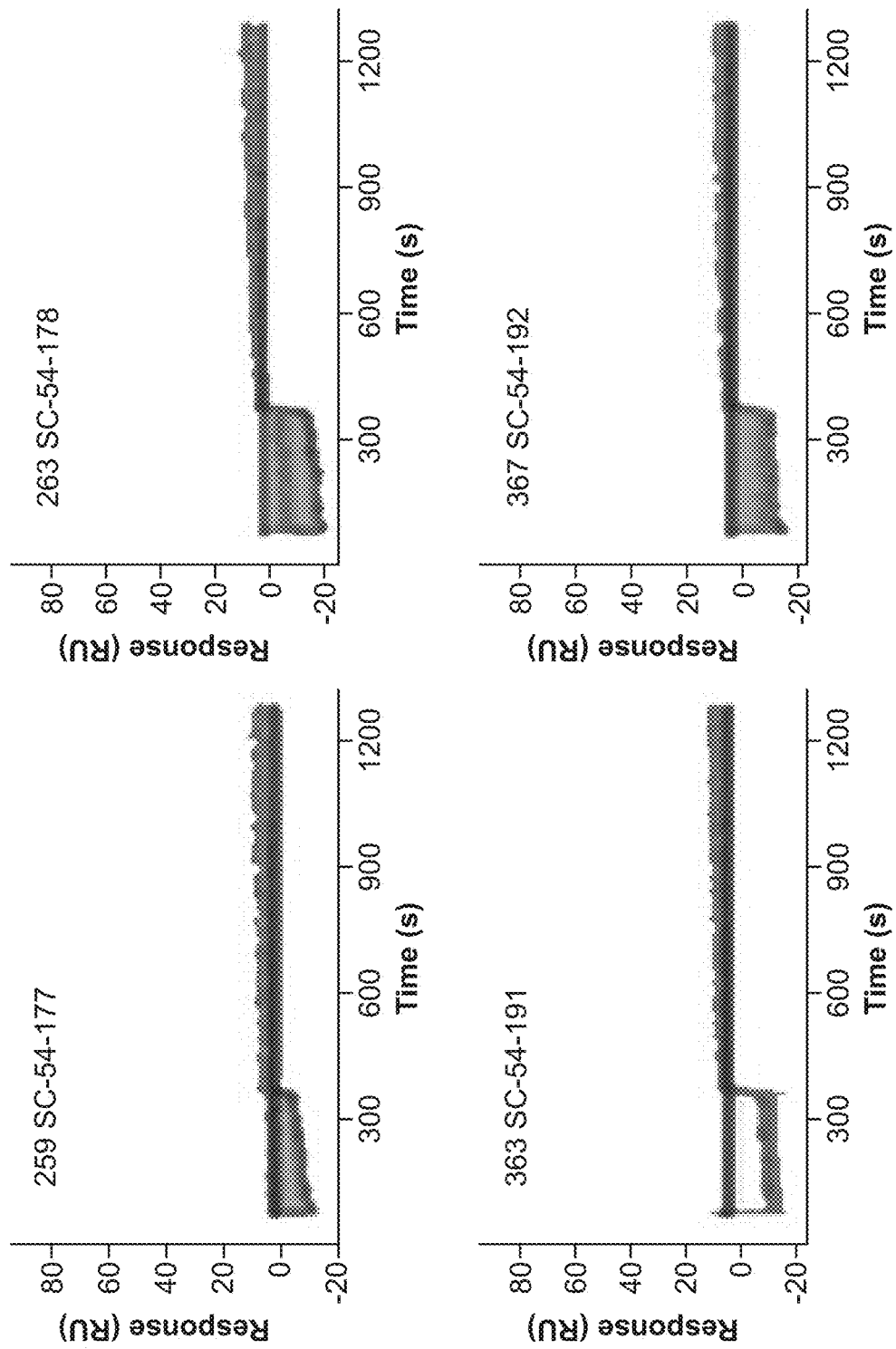
Figure 12D:
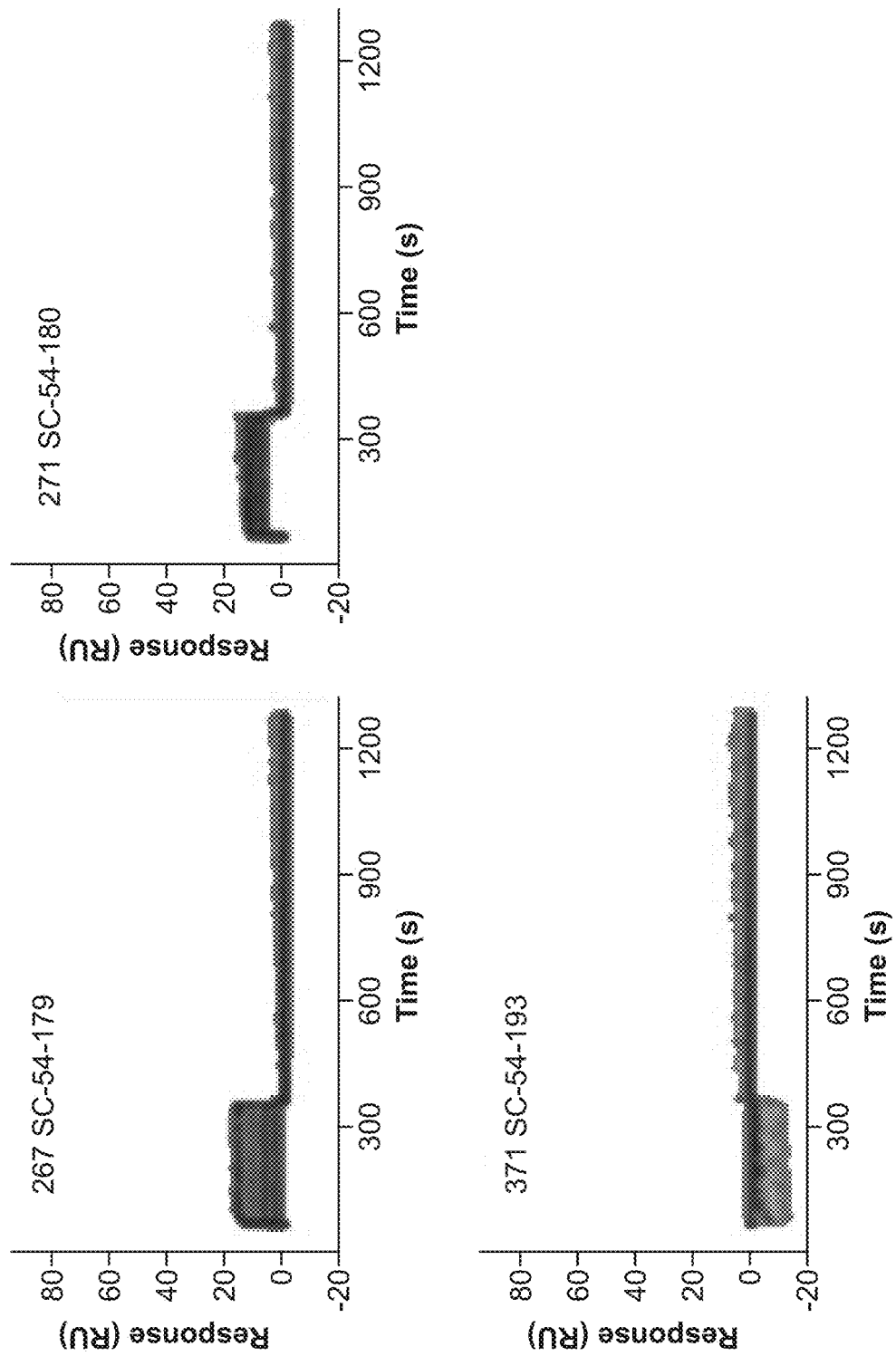
Figure 12D:
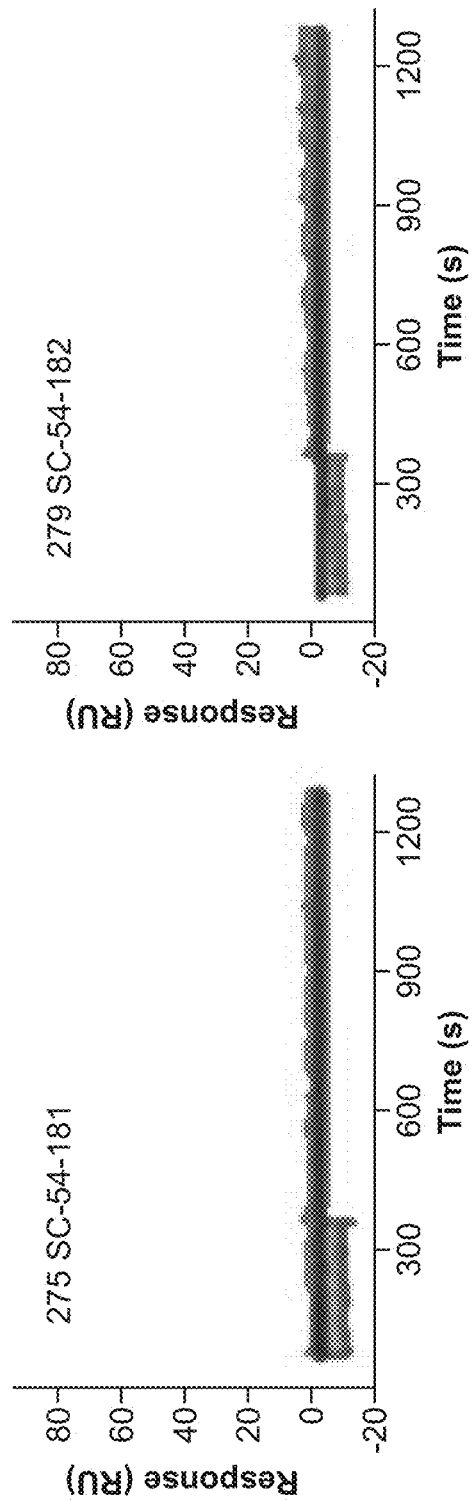

Variable heavy chain and light chain domains of anti-DKK1 antibodies were reformatted to IgG2, or VHH-Fc based on IgG2 Fc for nanobody leads. Reformatted leads were then DNA back-translated, synthesized, and cloned into mammalian expression vector pTwist CMV BG WPRE Neo. Light chain variable domains were reformatted into kappa and lambda frameworks accordingly. Clonal genes were delivered as purified plasmid DNA ready for transient transfection in HEK Expi293 cells (Thermo Fisher Scientific). Cultures in a volume of 1.2 mL were grown to four days, harvested, and purified using Protein A resin (PhyNexus) on the Hamilton Microlab STAR platform into 43 mM Citrate 148 mM HEPES, pH 6. 1.2 ml. Yield was calculated by measuring absorbance at 280 nm on Lunatic instrumentation (UNCLE). Results are depicted in FIG. 10A.

SPR experiments were performed on a Carterra LSA SPR biosensor equipped with a HC30M chip at 25° C. in HBS-TE. Antibodies were diluted to 10 μg/mL and amine-coupled to the sensor chip by EDC/NHS activation, followed by ethanolamine HCl quenching. Increasing concentrations of analyte were flowed over the sensor chip in HBS-TE with 0.5 mg/mL BSA with 5-minute association and 15-minute dissociation. Following each injection cycle the surface was regenerated with 2×30-second injections of IgG elution buffer (Thermo). Data were analyzed in Carterra's Kinetics Tool software with 1:1 binding model. Results are depicted in FIGS. 10B-C and 11A-B.

Figures 9A, 9B, 9C:
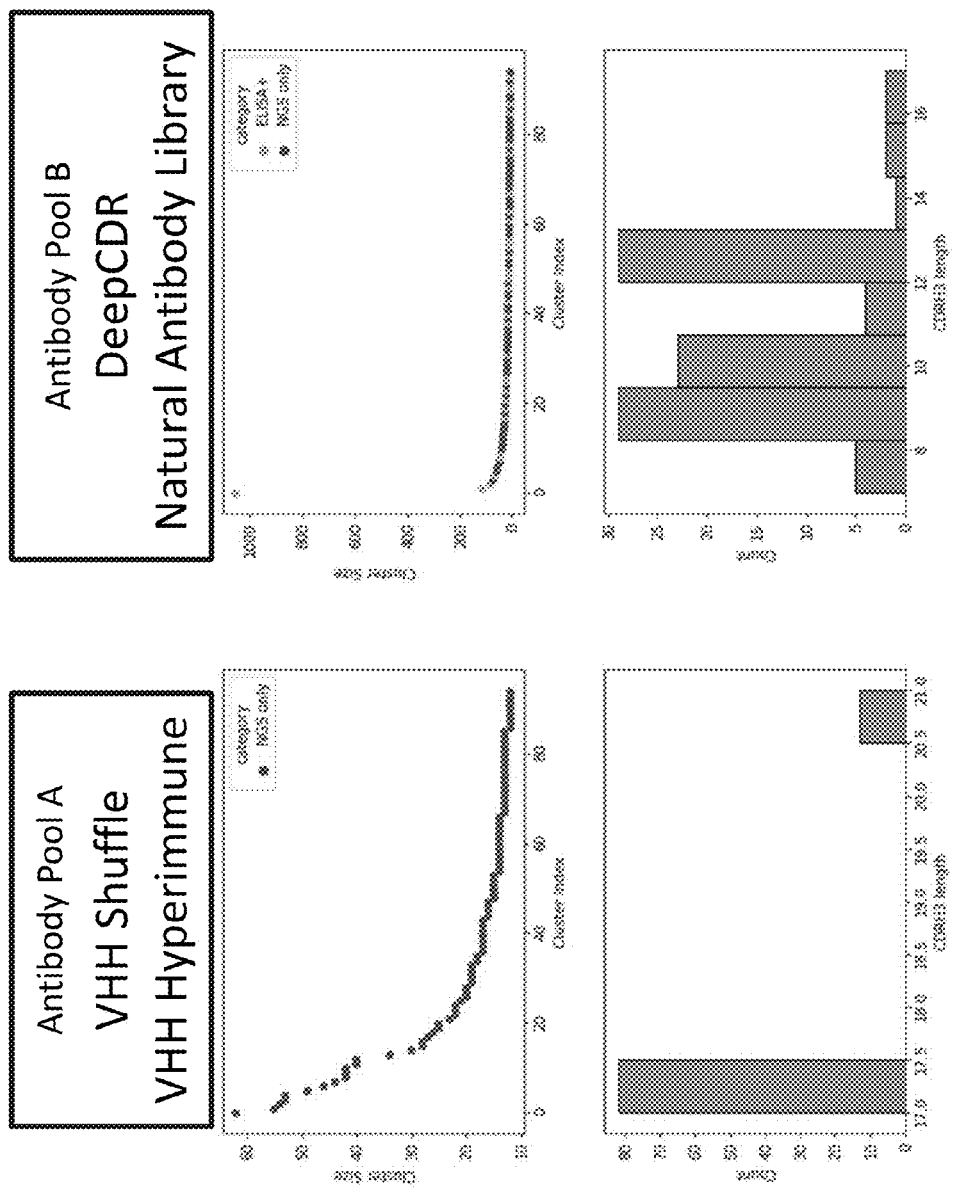
FIG. 9A depicts long read NGS sequencing of the eluted phage pool for antibody pool A. The top portion of the figure shows the cluster enrichment number, the number of instances the antibody appears, plotted against the cluster rank, which lists the antibody rank order of the antibodies by size cluster. The bottom portion of the figure shows the parallel histogram showing the distribution of the HCDR3 lengths among the top 95 antibody clusters.
FIG. 9B depicts long read NGS sequencing of the eluted phage pool for antibody pool B. The top portion of the figure shows the cluster enrichment number, the number of instances the antibody appears, plotted against the cluster rank, which lists the antibody rank order of the antibodies by size cluster. The bottom portion of the figure shows the parallel histogram showing the distribution of the HCDR3 lengths among the top 95 antibody clusters.
FIG. 9C depicts long read NGS sequencing of the eluted phage pool for antibody pool C. The top portion of the figure shows the cluster enrichment number, the number of instances the antibody appears, plotted against the cluster rank, which lists the antibody rank order of the antibodies by size cluster. The bottom portion of the figure shows the parallel histogram showing the distribution of the HCDR3 lengths among the top 95 antibody clusters.

Long-read NGS sequencing was performed by submitting PCR amplicons of DNA corresponding to the scFv or VHH of each clone to Loop Genomics for processing. Returned contiguous FASTQ files were processed by the AIRR Python API to extract and annotate antibody sequences. "NGS enrichment" refers to the number of instances that specific antibody appeared in round 4 sequencing. "Cluster enrichment" refers to the number of instances that the exact antibody appeared in round 4 or a variant within a Levenshtein distance of 3 appeared in round 4 sequencing. "Cluster rank" lists the antibody rank order of the antibody belonging to the largest size cluster enrichment to the lowest. Results can be seen in FIGS. 9A-C

TABLE 9

Antibody Yield, SPR Affinity, and Enrichment of Antibodies

| DKK1 Variant | 1.2 ml yield (ug) | ka (M-1 s-1) | kd (s-1) | KD (M) | Rmax (RU) | NGS Enrichment | Cluster Enrichment | Cluster Rank |
|---|---|---|---|---|---|---|---|---|
| DKK1-1 | 73.0 | — | — | — | — | — | — | — |
| DKK1-2 | 166.0 | — | — | — | — | — | — | — |
| DKK1-3 | 56.0 | — | — | — | — | — | — | — |
| DKK1-4 | 98.0 | — | — | — | — | — | — | — |
| DKK1-5 | 147.0 | — | — | — | — | — | — | — |
| DKK1-6 | 96.0 | 2.24E+05 | 8.60E-04 | 3.84E-09 | 90.1 | 48 | 53 | 5 |
| DKK1-7 | 131.0 | — | — | — | — | — | — | — |
| DKK1-8 | 232.0 | — | — | — | — | 3 | — | — |
| DKK1-9 | n/a | n/a | n/a | n/a | n/a | 3 | — | — |
| DKK1-10 | 105.0 | 4.51E+05 | 4.02E-04 | 8.92E-10 | 32.5 | 16 | 17 | 41 |
| DKK1-11 | 56.0 | — | — | — | — | 46 | 49 | 6 |
| DKK1-12 | 82.0 | — | — | — | — | 44 | 53 | 4 |
| DKK1-13 | 267.0 | — | — | — | — | 53 | 62 | 1 |
| DKK1-14 | 119.0 | — | — | — | — | 2 | — | — |
| DKK1-15 | 117.0 | — | — | — | — | 2 | — | — |

TABLE 9-continued

Antibody Yield, SPR Affinity, and Enrichment of Antibodies

| DKK1 Variant | 1.2 ml yield (ug) | ka (M−1 s−1) | kd (s−1) | KD (M) | Rmax (RU) | NGS Enrichment | Cluster Enrichment | Cluster Rank |
|---|---|---|---|---|---|---|---|---|
| DKK1-16 | 243.0 | — | — | — | — | 2 | — | — |
| DKK1-17 | 51.0 | — | — | — | — | 2 | — | — |
| DKK1-18 | 131.0 | 3.76E+04 | 1.29E−04 | 3.42E−09 | 18.5 | — | — | — |
| DKK1-19 | 96.0 | — | — | — | — | 5 | — | — |
| DKK1-20 | 5.0 | — | — | — | — | — | — | — |
| DKK1-21 | 307.0 | — | — | — | — | 1 | — | — |
| DKK1-22 | 211.0 | — | — | — | — | 1 | — | — |
| DKK1-23 | 89.0 | — | — | — | — | — | — | — |
| DKK1-24 | 40.0 | 4.21E+05 | 3.00E−04 | 7.13E−10 | 126.5 | 1 | — | — |
| DKK1-25 | 129.0 | — | — | — | — | — | — | — |
| DKK1-26 | 77.0 | 8.82E+05 | 1.00E−06 | 1.13E−12 | 18.8 | — | — | — |
| DKK1-27 | 192.0 | — | — | — | — | 33 | 40 | 13 |
| DKK1-28 | 84.0 | 6.27E+05 | 1.00E−05 | 1.59E−11 | 68.7 | 2 | — | — |
| DKK1-29 | 47.0 | — | — | — | — | — | — | — |
| DKK1-30 | 37.0 | 4.15E+05 | 3.03E−04 | 7.29E−10 | 95.1 | 3 | — | — |
| DKK1-31 | 42.0 | — | — | — | — | 9 | 17 | 40 |
| DKK1-32 | 157.0 | — | — | — | — | 8 | — | — |
| DKK1-33 | 68.0 | — | — | — | — | 12 | 13 | 84 |
| DKK1-34 | 180.0 | 3.46E+05 | 6.04E−04 | 1.75E−09 | 163.7 | 3 | — | — |
| DKK1-35 | 89.0 | — | — | — | — | 4 | 12 | 92 |
| DKK1-36 | 370.0 | — | — | — | — | 7 | 13 | 68 |
| DKK1-37 | 260.0 | 9.13E+04 | 9.16E−05 | 1.00E−09 | 42.5 | 24 | 30 | 15 |
| DKK1-38 | 61.0 | — | — | — | — | — | — | — |
| DKK1-39 | 28.0 | — | — | — | — | — | — | — |
| DKK1-40 | 7.0 | 1.10E+05 | 6.43E−04 | 5.86E−09 | 47.3 | — | — | — |
| DKK1-41 | 140.4 | 1.02E+05 | 8.28E−04 | 8.13E−09 | 224.6 | 9 | 17 | 40 |
| DKK1-42 | 124.0 | 8.91E+04 | 2.59E−03 | 2.91E−08 | 81.1 | 3 | 17 | 39 |
| DKK1-43 | 147.4 | 2.01E+05 | 3.93E−03 | 1.96E−08 | 230.7 | 10 | 17 | 38 |
| DKK1-44 | 110.0 | 1.78E+05 | 1.24E−04 | 6.93E−10 | 173.7 | 13 | 17 | 37 |
| DKK1-45 | 142.7 | 6.63E+04 | 1.72E−03 | 2.60E−08 | 218.5 | 12 | 18 | 36 |
| DKK1-46 | 124.0 | 1.27E+05 | 2.90E−03 | 2.27E−08 | 186.7 | 13 | 18 | 35 |
| DKK1-47 | 88.9 | 2.73E+05 | 6.68E−03 | 2.45E−08 | 161.5 | 11 | 19 | 34 |
| DKK1-48 | 72.5 | 9.94E+04 | 3.06E−03 | 3.08E−08 | 202.1 | 6 | 19 | 33 |
| DKK1-49 | 28.1 | 4.11E+04 | 3.18E−03 | 7.75E−08 | 88.4 | 16 | 19 | 32 |
| DKK1-50 | 138.1 | 9.14E+04 | 1.74E−03 | 1.90E−08 | 80.7 | 12 | 19 | 31 |
| DKK1-51 | 107.6 | 4.91E+04 | 4.25E−03 | 8.66E−08 | 161.0 | 18 | 19 | 30 |
| DKK1-52 | 152.1 | 8.29E+04 | 2.99E−03 | 3.60E−08 | 120.4 | 15 | 20 | 29 |
| DKK1-53 | 154.4 | 8.72E+04 | 3.54E−03 | 4.05E−08 | 187.4 | 15 | 20 | 28 |
| DKK1-54 | 152.1 | 1.06E+05 | 3.72E−04 | 3.51E−09 | 486.9 | 19 | 20 | 27 |
| DKK1-55 | 131.0 | 2.29E+05 | 8.89E−04 | 3.89E−09 | 535.3 | 16 | 21 | 26 |
| DKK1-56 | 163.8 | 4.34E+04 | 2.05E−03 | 4.72E−08 | 114.9 | 15 | 22 | 25 |
| DKK1-57 | 128.7 | 9.24E+04 | 3.06E−03 | 3.31E−08 | 232.1 | 11 | 22 | 24 |
| DKK1-58 | 79.6 | 9.61E+04 | 3.31E−03 | 3.44E−08 | 249.1 | 18 | 22 | 23 |
| DKK1-59 | 67.9 | 1.29E+05 | 1.40E−02 | 1.08E−07 | 230.6 | 9 | 23 | 22 |
| DKK1-60 | 42.1 | 1.02E+05 | 1.79E−03 | 1.75E−08 | 213.3 | 22 | 25 | 21 |
| DKK1-61 | 32.8 | 7.00E+04 | 4.39E−03 | 6.26E−08 | 170.1 | 13 | 25 | 20 |
| DKK1-62 | 65.5 | 1.26E+05 | 2.19E−03 | 1.74E−08 | 93.5 | 20 | 26 | 19 |
| DKK1-63 | 28.1 | n.b. | n.b. | n.b. | n.b. | 24 | 27 | 18 |
| DKK1-64 | 49.1 | n.b. | n.b. | n.b. | n.b. | 22 | 28 | 17 |
| DKK1-65 | 124.0 | 3.61E+04 | 2.26E−03 | 6.27E−08 | 133.1 | 23 | 28 | 16 |
| DKK1-66 | 49.1 | 1.23E+05 | 4.92E−03 | 3.99E−08 | 4450.4 | 24 | 30 | 15 |
| DKK1-67 | 81.9 | 2.17E+05 | 1.47E−03 | 6.77E−09 | 180.3 | 29 | 34 | 14 |
| DKK1-68 | 58.5 | 5.61E+04 | 2.42E−03 | 4.31E−08 | 77.9 | 33 | 40 | 13 |
| DKK1-69 | 51.5 | 1.08E+05 | 7.22E−04 | 6.68E−09 | 237.0 | 19 | 40 | 12 |
| DKK1-70 | 37.4 | 2.05E+05 | 2.14E−03 | 1.04E−08 | 333.0 | 29 | 42 | 11 |
| DKK1-71 | 42.1 | 1.13E+05 | 3.45E−03 | 3.06E−08 | 292.4 | 29 | 42 | 10 |
| DKK1-72 | 100.6 | 2.06E+05 | 3.62E−03 | 1.76E−08 | 133.7 | 35 | 42 | 9 |
| DKK1-73 | 51.5 | 1.03E+05 | 1.77E−03 | 1.71E−08 | 45.7 | 41 | 44 | 8 |
| DKK1-74 | 63.2 | 1.65E+05 | 4.31E−03 | 2.61E−08 | 205.2 | 34 | 16 | 7 |
| DKK1-75 | 74.9 | 1.05E+06 | 8.32E−03 | 7.90E−09 | 118.5 | 46 | 49 | 6 |
| DKK1-76 | 51.5 | 1.23E+05 | 2.03E−03 | 1.66E−08 | 240.7 | 48 | 53 | 5 |
| DKK1-77 | 28.1 | 1.26E+05 | 1.26E−03 | 1.00E−08 | 197.8 | 44 | 53 | 4 |
| DKK1-78 | 39.8 | 2.09E+05 | 3.52E−03 | 1.68E−08 | 290.0 | 43 | 54 | 3 |
| DKK1-79 | 53.8 | 1.58E+05 | 1.19E−03 | 7.55E−09 | 148.7 | 50 | 55 | 2 |
| DKK1-80 | 81.9 | 4.40E+05 | 7.60E−05 | 1.73E−10 | 190.9 | 53 | 62 | 1 |
| DKK1-81 | 79.6 | | | | | — | — | — |
| DKK1-82 | 7.0 | | | | | — | — | — |
| DKK1-83 | 98.3 | | | | | — | — | — |
| DKK1-84 | 67.9 | | | | | — | — | — |
| DKK1-85 | 4.7 | | | | | — | — | — |
| DKK1-86 | 16.4 | | | | | — | — | — |
| DKK1-87 | 149.8 | | | | | — | — | — |
| DKK1-88 | 238.7 | 5.94E+04 | 1.81E−03 | 3.06E−08 | 637.9 | 5 | — | — |
| DKK1-89 | 126.4 | 5.09E+04 | 4.35E−03 | 8.55E−08 | 405.5 | — | — | — |
| DKK1-90 | 322.9 | 3.73E+04 | 3.07E−03 | 8.23E−08 | 359.2 | — | — | — |

TABLE 9-continued

Antibody Yield, SPR Affinity, and Enrichment of Antibodies

| DKK1 Variant | 1.2 ml yield (ug) | ka (M−1 s−1) | kd (s−1) | KD (M) | Rmax (RU) | NGS Enrichment | Cluster Enrichment | Cluster Rank |
|---|---|---|---|---|---|---|---|---|
| DKK1-91 | 114.7 | 8.07E+04 | 1.03E−02 | 1.27E−07 | 439.7 | — | — | — |
| DKK1-92 | 152.1 | 9.36E+04 | 3.62E−03 | 3.87E−08 | 142.0 | — | — | — |
| DKK1-93 | 117.0 | 6.25E+04 | 4.13E−04 | 6.62E−09 | 422.2 | — | — | — |
| DKK1-94 | 98.3 | 7.24E+04 | 2.01E−03 | 2.78E−08 | 418.1 | — | — | — |
| DKK1-95 | 133.4 | 9.41E+04 | 2.69E−03 | 2.85E−08 | 491.0 | — | — | — |
| DKK1-96 | 163.8 | 6.03E+04 | 1.54E−03 | 2.54E−08 | 661.4 | — | — | — |
| DKK1-97 | 156.8 | 6.57E+04 | 1.00E−05 | 1.52E−10 | 411.3 | — | — | — |
| DKK1-98 | 154.4 | 1.34E+05 | 2.02E−01 | 1.50E−06 | 83.7 | — | — | — |

TABLE 10

Antibody Yield, SPR Affinity, and Enrichment of Antibodies

| TSLP Variant | yield | kon (M−1 s−1) | koff (s−1) | KD (M) | Rmax (RU) | 100 nM FACS (MFI Ratio) | EC50 FACS (nM) |
|---|---|---|---|---|---|---|---|
| DKK1-99 | 154.44 | 1.34E+05 | 2.02E−01 | 1.50E−06 | 83.7 | 1.70 | |
| DKK1-100 | 156.78 | 6.57E+04 | 1.00E−05 | 1.52E−10 | 411.3 | 5.30 | |
| DKK1-101 | 163.8 | 6.03E+04 | 1.54E−03 | 2.54E−08 | 661.4 | 16.90 | |
| DKK1-102 | 133.38 | 9.41E+04 | 2.69E−03 | 2.85E−08 | 491.0 | 8.00 | |
| DKK1-103 | 98.28 | 7.24E+04 | 2.01E−03 | 2.78E−08 | 418.1 | 9.10 | |
| DKK1-104 | 117 | 6.25E+04 | 4.13E−04 | 6.62E−09 | 422.2 | 6.90 | |
| DKK1-105 | 152.1 | 9.36E+04 | 3.62E−03 | 3.87E−08 | 142.0 | 2.10 | |
| DKK1-106 | 114.66 | 8.07E+04 | 1.03E−02 | 1.27E−07 | 439.7 | 4.20 | |
| DKK1-107 | 322.92 | 3.73E+04 | 3.07E−03 | 8.23E−08 | 359.2 | 1.30 | |
| DKK1-108 | 126.36 | 5.09E+04 | 4.35E−03 | 8.55E−08 | 405.5 | 1.10 | |
| DKK1-109 | 238.68 | 5.94E+04 | 1.81E−03 | 3.06E−08 | 637.9 | 15.50 | |
| DKK1-110 | 149.76 | | | | | 6.50 | |
| DKK1-111 | 16.38 | | | | | | |
| DKK1-112 | 4.68 | | | | | | |
| DKK1-113 | 67.86 | | | | | 2.20 | |
| DKK1-114 | 98.28 | | | | | 4.40 | |
| DKK1-115 | 7.02 | | | | | | |
| DKK1-116 | 79.56 | | | | | 3.50 | |
| DKK1-117 | 81.9 | 4.40E+05 | 7.60E−05 | 1.73E−10 | 190.9 | 45.10 | |
| DKK1-118 | 53.82 | 1.58E+05 | 1.19E−03 | 7.55E−09 | 148.7 | | |
| DKK1-119 | 39.78 | 2.09E+05 | 3.52E−03 | 1.68E−08 | 290.0 | | |
| DKK1-120 | 28.08 | 1.26E+05 | 1.26E−03 | 1.00E−08 | 197.8 | | |
| DKK1-121 | 51.48 | 1.23E+05 | 2.03E−03 | 1.66E−08 | 240.7 | | |
| DKK1-122 | 74.88 | 1.05E+06 | 8.32E−03 | 7.90E−09 | 118.5 | | |
| DKK1-123 | 63.18 | 1.65E+05 | 4.31E−03 | 2.61E−08 | 205.2 | | |
| DKK1-124 | 51.48 | 1.03E+05 | 1.77E−03 | 1.71E−08 | 45.7 | | |
| DKK1-125 | 100.62 | 2.06E+05 | 3.62E−03 | 1.76E−08 | 133.7 | | |
| DKK1-126 | 42.12 | 1.13E+05 | 3.45E−03 | 3.06E−08 | 292.4 | | |
| DKK1-127 | 37.44 | 2.05E+05 | 2.14E−03 | 1.04E−08 | 333.0 | | |
| DKK1-128 | 51.48 | 1.08E+05 | 7.22E−04 | 6.68E−09 | 237.0 | | |
| DKK1-129 | 58.5 | 5.61E+04 | 2.42E−03 | 4.31E−08 | 77.9 | | |
| DKK1-130 | 81.9 | 2.17E+05 | 1.47E−03 | 6.77E−09 | 180.3 | 30.00 | |
| DKK1-131 | 49.14 | 1.23E+05 | 4.92E−03 | 3.99E−08 | 4450.4 | | |
| DKK1-132 | 124.02 | 3.61E+04 | 2.26E−03 | 6.27E−08 | 133.1 | | |
| DKK1-133 | 49.14 | n.b. | n.b. | n.b. | n.b. | | |
| DKK1-134 | 28.08 | n.b. | n.b. | n.b. | n.b. | | |
| DKK1-135 | 65.52 | 1.26E+05 | 2.19E−03 | 1.74E−08 | 93.5 | | |
| DKK1-136 | 32.76 | 7.00E+04 | 4.39E−03 | 6.26E−08 | 170.1 | | |
| DKK1-137 | 42.12 | 1.02E+05 | 1.79E−03 | 1.75E−08 | 213.3 | | |
| DKK1-138 | 67.86 | 1.29E+05 | 1.40E−02 | 1.08E−07 | 230.6 | | |
| DKK1-139 | 79.56 | 9.61E+04 | 3.31E−03 | 3.44E−08 | 249.1 | | |
| DKK1-140 | 128.7 | 9.24E+04 | 3.06E−03 | 3.31E−08 | 232.1 | | |
| DKK1-141 | 163.8 | 4.34E+04 | 2.05E−03 | 4.72E−08 | 114.9 | | |
| DKK1-142 | 131.04 | 2.29E+05 | 8.89E−04 | 3.89E−09 | 535.3 | 4.20 | |
| DKK1-143 | 152.1 | 1.06E+05 | 3.72E−04 | 3.51E−09 | 486.9 | 22.40 | |
| DKK1-144 | 154.44 | 8.72E+04 | 3.54E−03 | 4.05E−08 | 187.4 | | |
| DKK1-145 | 152.1 | 8.29E+04 | 2.99E−03 | 3.60E−08 | 120.4 | | |
| DKK1-146 | 107.64 | 4.91E+04 | 4.25E−03 | 8.66E−08 | 161.0 | | |
| DKK1-147 | 138.06 | 9.14E+04 | 1.74E−03 | 1.90E−08 | 80.7 | | |
| DKK1-148 | 28.08 | 4.11E+04 | 3.18E−03 | 7.75E−08 | 88.4 | | |
| DKK1-149 | 72.54 | 9.94E+04 | 3.06E−03 | 3.08E−08 | 202.1 | | |
| DKK1-150 | 88.92 | 2.73E+05 | 6.68E−03 | 2.45E−08 | 161.5 | | |
| DKK1-151 | 124.02 | 1.27E+05 | 2.90E−03 | 2.27E−08 | 186.7 | | |
| DKK1-152 | 142.74 | 6.63E+04 | 1.72E−03 | 2.60E−08 | 218.5 | | |

TABLE 10-continued

Antibody Yield, SPR Affinity, and Enrichment of Antibodies

| TSLP Variant | yield | kon (M−1 s−1) | koff (s−1) | KD (M) | Rmax (RU) | 100 nM FACS (MFI Ratio) | EC50 FACS (nM) |
|---|---|---|---|---|---|---|---|
| DKK1-153 | 109.98 | 1.78E+05 | 1.24E−04 | 6.93E−10 | 173.7 | 7.20 | |
| DKK1-154 | 147.42 | 2.01E+05 | 3.93E−03 | 1.96E−08 | 230.7 | | |
| DKK1-155 | 124.02 | 8.91E+04 | 2.59E−03 | 2.91E−08 | 81.1 | | |
| DKK1-156 | 140.4 | 1.02E+05 | 8.28E−04 | 8.13E−09 | 224.6 | | |
| DKK1-157 | 180.18 | 1.23E+04 | 3.73E−03 | 3.03E−07 | 196.2 | | |
| DKK1-158 | 58.5 | 4.77E+05 | 1.01E−02 | 2.12E−08 | 175.5 | | |
| DKK1-159 | 72.54 | 8.09E+04 | 1.93E−03 | 2.39E−08 | 266.8 | | |
| DKK1-160 | 93.6 | 1.02E+05 | 3.08E−04 | 3.03E−09 | 295.9 | | |
| DKK1-161 | 58.5 | 2.61E+05 | 4.68E−03 | 1.79E−08 | 231.9 | | |
| DKK1-162 | 105.3 | 6.41E+04 | 2.95E−03 | 4.60E−08 | 224.6 | | |
| DKK1-163 | 44.46 | 1.38E+02 | 1.77E−02 | 1.28E−04 | 16396.4 | | |
| DKK1-164 | 168.48 | 2.00E+04 | 2.14E−03 | 1.07E−07 | 293.9 | | |
| DKK1-165 | 163.8 | 1.55E+05 | 2.83E−03 | 1.83E−08 | 70.4 | | |
| DKK1-166 | 152.1 | 9.84E+04 | 2.58E−03 | 2.62E−08 | 321.8 | | |
| DKK1-167 | 39.78 | 1.65E+04 | 2.83E−02 | 1.71E−06 | 950.7 | | |
| DKK1-168 | 74.88 | 1.88E+05 | 7.97E−03 | 4.23E−08 | 165.5 | | |
| DKK1-169 | 140.4 | 7.50E+04 | 4.68E−03 | 6.23E−08 | 261.2 | | |
| DKK1-170 | 128.7 | n.b. | n.b. | n.b. | n.b. | | |
| DKK1-171 | 18.72 | 5.83E+04 | 2.06E−03 | 3.54E−08 | 67.4 | | |
| DKK1-172 | 86.58 | 2.29E+04 | 3.05E−03 | 1.33E−07 | 264.4 | | |
| DKK1-173 | 147.42 | 1.59E+05 | 2.62E−03 | 1.65E−08 | 217.9 | | |
| DKK1-174 | 42.12 | 9.10E+04 | 3.53E−03 | 3.88E−08 | 250.0 | | |
| DKK1-175 | 65.52 | 1.74E+05 | 3.45E−03 | 1.98E−08 | 129.8 | | |
| DKK1-176 | 51.48 | 6.53E+04 | 4.68E−03 | 7.17E−08 | 154.3 | | |
| DKK1-177 | 100.62 | 5.92E+04 | 1.70E−02 | 2.87E−07 | 178.9 | | |
| DKK1-178 | 156.78 | 1.93E+05 | 1.27E−03 | 6.61E−09 | 277.4 | 7.00 | |
| DKK1-179 | 77.22 | 6.18E+04 | 5.17E−03 | 8.36E−08 | 213.3 | | |
| DKK1-180 | 42.12 | 6.27E+04 | 3.49E−03 | 5.56E−08 | 164.6 | | |
| DKK1-181 | 35.1 | 1.66E+05 | 7.46E−03 | 4.48E−08 | 181.8 | | |
| DKK1-182 | 65.52 | 3.44E+05 | 3.24E−03 | 9.40E−09 | 231.3 | | |
| DKK1-183 | 35.1 | 7.32E+04 | 2.53E−03 | 3.46E−08 | 41.7 | | |
| DKK1-184 | 65.52 | 1.12E+05 | 2.35E−04 | 2.11E−09 | 386.0 | 13.80 | |
| DKK1-185 | 49.14 | 1.56E+05 | 5.80E−03 | 3.73E−08 | 245.3 | | |
| DKK1-186 | 67.86 | 9.26E+04 | 4.76E−03 | 5.14E−08 | 194.5 | | |
| DKK1-187 | 86.58 | 2.06E+05 | 3.44E−03 | 1.67E−08 | 168.1 | | |
| DKK1-188 | 49.14 | 1.37E+05 | 1.49E−03 | 1.08E−08 | 435.0 | | |
| DKK1-189 | 49.14 | 2.64E+05 | 9.14E−03 | 3.47E−08 | 231.2 | | |
| DKK1-190 | 65.52 | 8.99E+04 | 8.75E−04 | 9.74E−09 | 149.6 | | |
| DKK1-191 | 70.2 | 1.10E+05 | 5.76E−05 | 5.26E−10 | 378.2 | 4.40 | |
| DKK1-192 | 91.26 | 4.78E+04 | 1.76E−03 | 3.68E−08 | 167.7 | | |
| DKK1-193 | 74.88 | 2.03E+05 | 7.54E−03 | 3.71E−08 | 183.7 | | |
| DKK1-194 | 79.56 | n.b. | n.b. | n.b. | n.b. | | |
| DKK1-195 | 70.2 | 4.34E+04 | 3.05E−03 | 7.04E−08 | 271.6 | | |
| DKK1-196 | 149.76 | 9.80E+04 | 2.01E−03 | 2.05E−08 | 438.6 | | |
| DKK1-197 | 124.02 | 2.81E+05 | 2.41E−03 | 8.58E−09 | 112.5 | | |
| DKK1-198 | 86.58 | 1.15E+05 | 3.42E−03 | 2.97E−08 | 228.1 | | |
| DKK1-199 | 63.18 | 7.56E+04 | 5.46E−03 | 7.23E−08 | 200.8 | | |
| DKK1-200 | 133.38 | 4.66E+04 | 1.63E−03 | 3.49E−08 | 112.0 | | |
| DKK1-201 | 58.5 | 1.45E+05 | 9.81E−03 | 6.74E−08 | 141.5 | | |
| DKK1-202 | 58.5 | 1.57E+05 | 1.09E−02 | 6.92E−08 | 248.8 | | |
| DKK1-203 | 112.32 | 6.07E+04 | 6.57E−04 | 1.08E−08 | 317.8 | | |
| DKK1-204 | 114.66 | 8.36E+04 | 1.95E−03 | 2.33E−08 | 280.2 | | |
| DKK1-205 | 105.3 | n.b. | n.b. | n.b. | n.b. | | |
| DKK1-206 | 147.42 | n.b. | n.b. | n.b. | n.b. | | |
| DKK1-207 | 147.42 | 3.42E+05 | 2.46E−03 | 7.19E−09 | 158.5 | | |
| DKK1-208 | 154.44 | 9.36E+04 | 2.24E−04 | 2.39E−09 | 310.2 | | |
| DKK1-209 | 159.12 | 1.82E+05 | 1.03E−03 | 5.64E−09 | 260.8 | 18.00 | |
| DKK1-210 | 128.7 | n.b. | n.b. | n.b. | n.b. | | |
| DKK1-211 | 91.26 | n.b. | n.b. | n.b. | n.b. | | |
| DKK1-212 | 9.36 | | | | | | |
| DKK1-213 | 0 | | | | | 0.70 | |
| DKK1-214 | 7.02 | | | | | 0.20 | |
| DKK1-215 | 28.08 | | | | | 0.20 | |
| DKK1-216 | 7.02 | | | | | 0.10 | |
| DKK1-217 | 44.46 | | | | | 0.20 | |
| DKK1-218 | 7.02 | | | | | | |
| DKK1-219 | 7.02 | | | | | 0.60 | |
| DKK1-220 | 11.7 | n.b. | n.b. | n.b. | n.b. | | |
| DKK1-221 | 18.72 | n.b. | n.b. | n.b. | n.b. | 1.00 | |
| DKK1-222 | 18.72 | n.b. | n.b. | n.b. | n.b. | 1.60 | |
| DKK1-223 | 14.04 | n.b. | n.b. | n.b. | n.b. | 2.20 | |
| DKK1-224 | 21.06 | | | | | | |
| DKK1-225 | 16.38 | | | | | 1.20 | |
| DKK1-226 | 14.04 | 1.25E+05 | 8.99E−02 | 7.17E−07 | 42.1 | 2.60 | |

TABLE 10-continued

Antibody Yield, SPR Affinity, and Enrichment of Antibodies

| TSLP Variant | yield | kon (M−1 s−1) | koff (s−1) | KD (M) | Rmax (RU) | 100 nM FACS (MFI Ratio) | EC50 FACS (nM) |
|---|---|---|---|---|---|---|---|
| DKK1-227 | 25.74 | | | | | 0.40 | |
| DKK1-228 | 11.7 | 4.50E+05 | 1.06E−02 | 2.35E−08 | 94.0 | 1.10 | |
| DKK1-229 | 25.74 | n.b. | n.b. | n.b. | n.b. | 1.50 | |
| DKK1-230 | 18.72 | | | | | 0.20 | |
| DKK1-231 | 4.68 | | | | | | |
| DKK1-232 | 56.16 | | | | | 36.50 | |
| DKK1-233 | 2.34 | n.b. | n.b. | n.b. | n.b. | | |
| DKK1-234 | 25.74 | | | | | 1.30 | |
| DKK1-235 | 35.1 | | | | | 6.50 | |
| DKK1-236 | 9.36 | | | | | 0.10 | |
| DKK1-237 | 21.06 | n.b. | n.b. | n.b. | n.b. | 4.10 | |
| DKK1-238 | 14.04 | n.b. | n.b. | n.b. | n.b. | 0.30 | |
| DKK1-239 | 11.7 | | | | | 0.70 | |
| DKK1-240 | 4.68 | | | | | | |
| DKK1-241 | 102.96 | | | | | 0.70 | |
| DKK1-242 | 4.68 | | | | | | |
| DKK1-243 | 35.1 | | | | | 10.30 | |
| DKK1-244 | 7.02 | | | | | 2.90 | |
| DKK1-245 | 11.7 | n.b. | n.b. | n.b. | n.b. | 319.70 | |
| DKK1-246 | 4.68 | | | | | 0.30 | |
| DKK1-247 | 4.68 | 1.83E+04 | 8.02E−03 | 4.39E−07 | 58.1 | 0.20 | |
| DKK1-248 | 112.32 | 3.73E+05 | 4.63E−03 | 1.24E−08 | 541.0 | 26.00 | |
| DKK1-249 | 7.02 | n.b. | n.b. | n.b. | n.b. | | |
| DKK1-250 | 9.36 | | | | | 0.70 | |
| DKK1-251 | 4.68 | n.b. | n.b. | n.b. | n.b. | | |
| DKK1-252 | 4.68 | | | | | | |
| DKK1-253 | 18.72 | n.b. | n.b. | n.b. | n.b. | 0.20 | |
| DKK1-254 | 53.82 | 1.39E+05 | 2.36E−02 | 1.70E−07 | 256.8 | 2.50 | |
| DKK1-255 | 2.34 | | | | | | |
| DKK1-256 | 49.14 | n.b. | n.b. | n.b. | n.b. | 0.10 | |
| DKK1-257 | 11.7 | n.b. | n.b. | n.b. | n.b. | 0.10 | |
| DKK1-258 | | | | | | | |
| DKK1-259 | 0 | | | | | | |
| DKK1-260 | 16.38 | n.b. | n.b. | n.b. | n.b. | | |
| DKK1-261 | 4.68 | n.b. | n.b. | n.b. | n.b. | | |
| DKK1-262 | 11.7 | n.b. | n.b. | n.b. | n.b. | | |
| DKK1-263 | 18.72 | n.b. | n.b. | n.b. | n.b. | | |
| DKK1-264 | 4.68 | n.b. | n.b. | n.b. | n.b. | | |
| DKK1-265 | 9.36 | n.b. | n.b. | n.b. | n.b. | | |
| DKK1-266 | 4.68 | n.b. | n.b. | n.b. | n.b. | | |
| DKK1-267 | 7.02 | n.b. | n.b. | n.b. | n.b. | | |
| DKK1-268 | 42.12 | n.b. | n.b. | n.b. | n.b. | | |
| DKK1-269 | 14.04 | n.b. | n.b. | n.b. | n.b. | | |
| DKK1-270 | 25.74 | n.b. | n.b. | n.b. | n.b. | | |
| DKK1-271 | 21.06 | n.b. | n.b. | n.b. | n.b. | | |
| DKK1-272 | 11.7 | n.b. | n.b. | n.b. | n.b. | | |
| DKK1-273 | 18.72 | n.b. | n.b. | n.b. | n.b. | | |
| DKK1-274 | 7.02 | n.b. | n.b. | n.b. | n.b. | | |
| DKK1-275 | 2.34 | n.b. | n.b. | n.b. | n.b. | | |
| DKK1-276 | 7.02 | n.b. | n.b. | n.b. | n.b. | | |
| DKK1-277 | 9.36 | n.b. | n.b. | n.b. | n.b. | | |
| DKK1-278 | 9.36 | n.b. | n.b. | n.b. | n.b. | | |
| DKK1-279 | 7.02 | n.b. | n.b. | n.b. | n.b. | | |
| DKK1-280 | 21.06 | n.b. | n.b. | n.b. | n.b. | | |
| DKK1-281 | 16.38 | n.b. | n.b. | n.b. | n.b. | | |
| DKK1-282 | 18.72 | n.b. | n.b. | n.b. | n.b. | | |
| DKK1-283 | 25.74 | 1.30E+05 | 3.35E−03 | 2.58E−08 | 355.6 | | |
| DKK1-284 | 51.48 | n.b. | n.b. | n.b. | n.b. | | |
| DKK1-285 | 49.14 | n.b. | n.b. | n.b. | n.b. | | |
| DKK1-286 | 16.38 | n.b. | n.b. | n.b. | n.b. | | |
| DKK1-287 | 14.04 | n.b. | n.b. | n.b. | n.b. | | |
| DKK1-288 | 9.36 | n.b. | n.b. | n.b. | n.b. | | |
| DKK1-289 | 70.2 | n.b. | n.b. | n.b. | n.b. | | |
| DKK1-290 | 35.1 | 9.25E+04 | 2.42E−03 | 2.61E−08 | 123.8 | | |
| DKK1-291 | 25.74 | n.b. | n.b. | n.b. | n.b. | | |
| DKK1-292 | 2.34 | n.b. | n.b. | n.b. | n.b. | | |
| DKK1-293 | 28.08 | n.b. | n.b. | n.b. | n.b. | | |
| DKK1-294 | 23.4 | 2.23E+04 | 4.74E−03 | 2.12E−07 | 135.9 | | |
| DKK1-295 | 18.72 | n.b. | n.b. | n.b. | n.b. | | |
| DKK1-296 | 7.02 | n.b. | n.b. | n.b. | n.b. | | |
| DKK1-297 | | n.b. | n.b. | n.b. | n.b. | | |
| DKK1-298 | | n.b. | n.b. | n.b. | n.b. | | |
| DKK1-299 | | n.b. | n.b. | n.b. | n.b. | | |
| DKK1-300 | | n.b. | n.b. | n.b. | n.b. | | |

TABLE 10-continued

Antibody Yield, SPR Affinity, and Enrichment of Antibodies

| TSLP Variant | yield | kon (M−1 s−1) | koff (s−1) | KD (M) | Rmax (RU) | 100 nM FACS (MFI Ratio) | EC50 FACS (nM) |
|---|---|---|---|---|---|---|---|
| DKK1-301 |  | n.b. | n.b. | n.b. | n.b. | | |
| DKK1-302 | 21.06 | n.b. | n.b. | n.b. | n.b. | | |
| DKK1-303 | 7.02 | n.b. | n.b. | n.b. | n.b. | | |
| DKK1-304 | 14.04 | n.b. | n.b. | n.b. | n.b. | | |
| DKK1-305 | 53.82 | n.b. | n.b. | n.b. | n.b. | | |
| DKK1-306 |  | n.b. | n.b. | n.b. | n.b. | | |
| DKK1-307 |  | n.b. | n.b. | n.b. | n.b. | | |
| DKK1-308 |  | n.b. | n.b. | n.b. | n.b. | | |
| DKK1-309 |  | n.b. | n.b. | n.b. | n.b. | | |
| DKK1-310 |  | n.b. | n.b. | n.b. | n.b. | | |
| DKK1-311 |  | n.b. | n.b. | n.b. | n.b. | | |
| DKK1-312 | 4.68 | n.b. | n.b. | n.b. | n.b. | | |
| DKK1-313 |  | n.b. | n.b. | n.b. | n.b. | | |
| DKK1-314 | 32.76 | n.b. | n.b. | n.b. | n.b. | | |
| DKK1-315 | 11.7 | n.b. | n.b. | n.b. | n.b. | | |
| DKK1-316 | 7.02 | n.b. | n.b. | n.b. | n.b. | | |
| DKK1-317 | 11.7 | n.b. | n.b. | n.b. | n.b. | | |
| DKK1-318 | 32.76 | n.b. | n.b. | n.b. | n.b. | | |
| DKK1-319 | 23.4 | n.b. | n.b. | n.b. | n.b. | | |
| DKK1-320 | 7.02 | n.b. | n.b. | n.b. | n.b. | | |
| DKK1-321 | 63.18 | 3.72E+05 | 3.04E−03 | 8.17E−09 | 154.1 | 92.00 | |
| DKK1-322 | 74.88 | 4.82E+05 | 8.51E−03 | 1.77E−08 | 387.2 | 38.70 | |
| DKK1-323 | 56.16 | n.b. | n.b. | n.b. | n.b. | 3.40 | |
| DKK1-324 | 79.56 | n.b. | n.b. | n.b. | n.b. | 0.80 | |
| DKK1-325 | 21.06 | 5.04E+05 | 4.22E−03 | 8.39E−09 | 93.7 | 17.90 | |
| DKK1-326 | 58.5 | 3.34E+05 | 2.98E−03 | 8.92E−09 | 58.8 | | |
| DKK1-327 | 32.76 | 4.66E+05 | 4.80E−03 | 1.03E−08 | 75.1 | | |
| DKK1-328 | 21.06 | n.b. | n.b. | n.b. | n.b. | | |
| DKK1-329 | 18.72 | n.b. | n.b. | n.b. | n.b. | | |
| DKK1-330 | 7.02 | n.b. | n.b. | n.b. | n.b. | | |
| DKK1-331 | 16.38 | n.b. | n.b. | n.b. | n.b. | | |
| DKK1-332 | 28.08 | 1.55E+05 | 6.92E−04 | 4.48E−09 | 619.7 | 13.30 | |
| DKK1-333 | 9.36 | n.b. | n.b. | n.b. | n.b. | | |
| DKK1-334 | 16.38 | 1.31E+05 | 7.03E−03 | 5.36E−08 | 144.8 | | |
| DKK1-335 | 70.2 | 1.01E+05 | 1.37E−03 | 1.36E−08 | 48.7 | | |
| DKK1-336 | 44.46 | 5.67E+04 | 1.75E−01 | 3.10E−06 | 76.9 | | |
| DKK1-337 | 30.42 | 4.83E+05 | 1.74E−03 | 3.61E−09 | 314.7 | 3.30 | |
| DKK1-338 | 11.7 | n.b. | n.b. | n.b. | n.b. | | |
| DKK1-339 | 35.1 | 4.23E+05 | 4.81E−03 | 1.14E−08 | 60.1 | | |
| DKK1-340 | 42.12 | n.b. | n.b. | n.b. | n.b. | | |
| DKK1-341 | 9.36 | n.b. | n.b. | n.b. | n.b. | | |
| DKK1-342 | 9.36 | 4.85E+05 | 1.98E−03 | 4.09E−09 | 72.2 | 1.90 | |
| DKK1-343 | 11.7 | n.b. | n.b. | n.b. | n.b. | | |
| DKK1-344 | 23.4 | n.b. | n.b. | n.b. | n.b. | | |
| DKK1-345 | 7.02 | n.b. | n.b. | n.b. | n.b. | | |
| DKK1-346 | 4.68 | 3.28E+06 | 4.85E−02 | 1.48E−08 | 51.5 | | |
| DKK1-347 | 4.68 | n.b. | n.b. | n.b. | n.b. | | |
| DKK1-348 | 11.7 | n.b. | n.b. | n.b. | n.b. | | |
| DKK1-349 | 7.02 | n.b. | n.b. | n.b. | n.b. | | |
| DKK1-350 | 11.7 | n.b. | n.b. | n.b. | n.b. | | |
| DKK1-351 | 16.38 | n.b. | n.b. | n.b. | n.b. | | |
| DKK1-352 | 2.34 | n.b. | n.b. | n.b. | n.b. | | |
| DKK1-353 | 7.02 | n.b. | n.b. | n.b. | n.b. | | |
| DKK1-354 | 7.02 | n.b. | n.b. | n.b. | n.b. | | |
| DKK1-355 | 11.7 | 2.26E+05 | 1.31E−02 | 5.79E−08 | 127.4 | | |
| DKK1-356 | 4.68 | n.b. | n.b. | n.b. | n.b. | | |
| DKK1-357 | 7.02 | n.b. | n.b. | n.b. | n.b. | | |
| DKK1-358 | 30.42 | 4.66E+04 | 2.22E−03 | 4.77E−08 | 94.2 | | |
| DKK1-359 | 7.02 | n.b. | n.b. | n.b. | n.b. | | |
| DKK1-360 | 11.7 | n.b. | n.b. | n.b. | n.b. | | |
| DKK1-361 | 7.02 | 3.93E+05 | 5.20E−03 | 1.32E−08 | 53.5 | | |
| DKK1-362 | 16.38 | n.b. | n.b. | n.b. | n.b. | | |
| DKK1-363 | 9.36 | n.b. | n.b. | n.b. | n.b. | | |
| DKK1-364 | 7.02 | 2.36E+05 | 3.16E−03 | 1.34E−08 | 47.4 | | |
| DKK1-365 | 7.02 | n.b. | n.b. | n.b. | n.b. | | |
| DKK1-366 | 7.02 | n.b. | n.b. | n.b. | n.b. | | |
| DKK1-367 | 14.04 | n.b. | n.b. | n.b. | n.b. | | |
| DKK1-368 | 7.02 | 4.23E+03 | 2.53E−02 | 5.97E−06 | 2264.0 | | |
| DKK1-369 | 9.36 | n.b. | n.b. | n.b. | n.b. | | |
| DKK1-370 | 4.68 | n.b. | n.b. | n.b. | n.b. | | |
| DKK1-371 | 7.02 | n.b. | n.b. | n.b. | n.b. | | |
| DKK1-372 | 7.02 | 5.47E+04 | 3.29E−03 | 6.01E−08 | 71.5 | | |
| DKK1-373 | 7.02 | n.b. | n.b. | n.b. | n.b. | | |
| DKK1-374 | 7.02 | n.b. | n.b. | n.b. | n.b. | | |

TABLE 10-continued

Antibody Yield, SPR Affinity, and Enrichment of Antibodies

| TSLP Variant | yield | kon (M−1 s−1) | koff (s−1) | KD (M) | Rmax (RU) | 100 nM FACS (MFI Ratio) | EC50 FACS (nM) |
|---|---|---|---|---|---|---|---|
| DKK1-375 | 9.36 | n.b. | n.b. | n.b. | n.b. | | |
| DKK1-376 | 9.36 | 3.77E+05 | 3.05E−03 | 8.08E−09 | 286.0 | 4.00 | |
| DKK1-377 | 11.7 | n.b. | n.b. | n.b. | n.b. | | |
| DKK1-378 | 4.68 | n.b. | n.b. | n.b. | n.b. | | |
| DKK1-379 | 18.72 | n.b. | n.b. | n.b. | n.b. | | |
| DKK1-380 | 18.72 | n.b. | n.b. | n.b. | n.b. | | |
| DKK1-381 | 2.34 | n.b. | n.b. | n.b. | n.b. | | |
| DKK1-382 | 46.8 | 4.16E+05 | 1.10E−03 | 2.65E−09 | 301.7 | 7.10 | |
| DKK1-383 | 63.18 | n.b. | n.b. | n.b. | n.b. | | |
| DKK1-384 | 14.04 | n.b. | n.b. | n.b. | n.b. | | |
| DKK1-385 | 9.36 | n.b. | n.b. | n.b. | n.b. | | |
| DKK1-386 | 25.74 | n.b. | n.b. | n.b. | n.b. | | |
| DKK1-387 | 9.36 | n.b. | n.b. | n.b. | n.b. | | |
| DKK1-388 | 11.7 | n.b. | n.b. | n.b. | n.b. | | |
| DKK1-389 | 2.34 | n.b. | n.b. | n.b. | n.b. | | |
| DKK1-390 | 18.72 | n.b. | n.b. | n.b. | n.b. | | |
| DKK1-391 | 4.68 | 1.25E+06 | 4.17E−02 | 3.34E−08 | 86.0 | | |
| DKK1-392 | 7.02 | n.b. | n.b. | n.b. | n.b. | | |
| DKK1-393 | 16.38 | 3.34E+05 | 1.97E−03 | 5.92E−09 | 190.4 | 15.90 | |
| DKK1-394 | 7.02 | n.b. | n.b. | n.b. | n.b. | | |
| DKK1-395 | 11.7 | n.b. | n.b. | n.b. | n.b. | | |
| DKK1-396 | 37.44 | 6.22E+05 | 9.97E−03 | 1.60E−08 | 121.9 | | |
| DKK1-397 | 63.18 | n.b. | n.b. | n.b. | n.b. | | |
| DKK1-398 | 39.78 | n.b. | n.b. | n.b. | n.b. | | |
| DKK1-399 | 18.72 | n.b. | n.b. | n.b. | n.b. | | |
| DKK1-400 | 51.48 | n.b. | n.b. | n.b. | n.b. | | |
| DKK1-401 | 39.78 | n.b. | n.b. | n.b. | n.b. | | |
| DKK1-402 | 39.78 | n.b. | n.b. | n.b. | n.b. | | |
| DKK1-403 | 11.7 | n.b. | n.b. | n.b. | n.b. | | |
| DKK1-404 | 9.36 | n.b. | n.b. | n.b. | n.b. | | |
| DKK1-405 | 11.7 | n.b. | n.b. | n.b. | n.b. | | |
| DKK1-406 | 9.36 | n.b. | n.b. | n.b. | n.b. | | |
| DKK1-407 | 35.1 | n.b. | n.b. | n.b. | n.b. | | |
| DKK1-408 | 32.76 | 2.04E+05 | 3.91E−03 | 1.91E−08 | 405.1 | | |
| DKK1-409 | 25.74 | n.b. | n.b. | n.b. | n.b. | | |
| DKK1-410 | 4.68 | n.b. | n.b. | n.b. | n.b. | | |
| DKK1-411 | 11.7 | n.b. | n.b. | n.b. | n.b. | | |
| DKK1-412 | 32.76 | n.b. | n.b. | n.b. | n.b. | | |
| DKK1-413 | 2.34 | n.b. | n.b. | n.b. | n.b. | | |
| DKK1-414 | 18.72 | 9.75E+04 | 1.82E−03 | 1.87E−08 | 126.3 | | |
| DKK1-415 | 14.04 | n.b. | n.b. | n.b. | n.b. | | |
| DKK1-416 | 11.7 | n.b. | n.b. | n.b. | n.b. | | |
| DKK1-417 | 28.08 | n.b. | n.b. | n.b. | n.b. | | |

Example 5: Panning and Screening for Identification of Antibodies for DKK1

Figure 21:
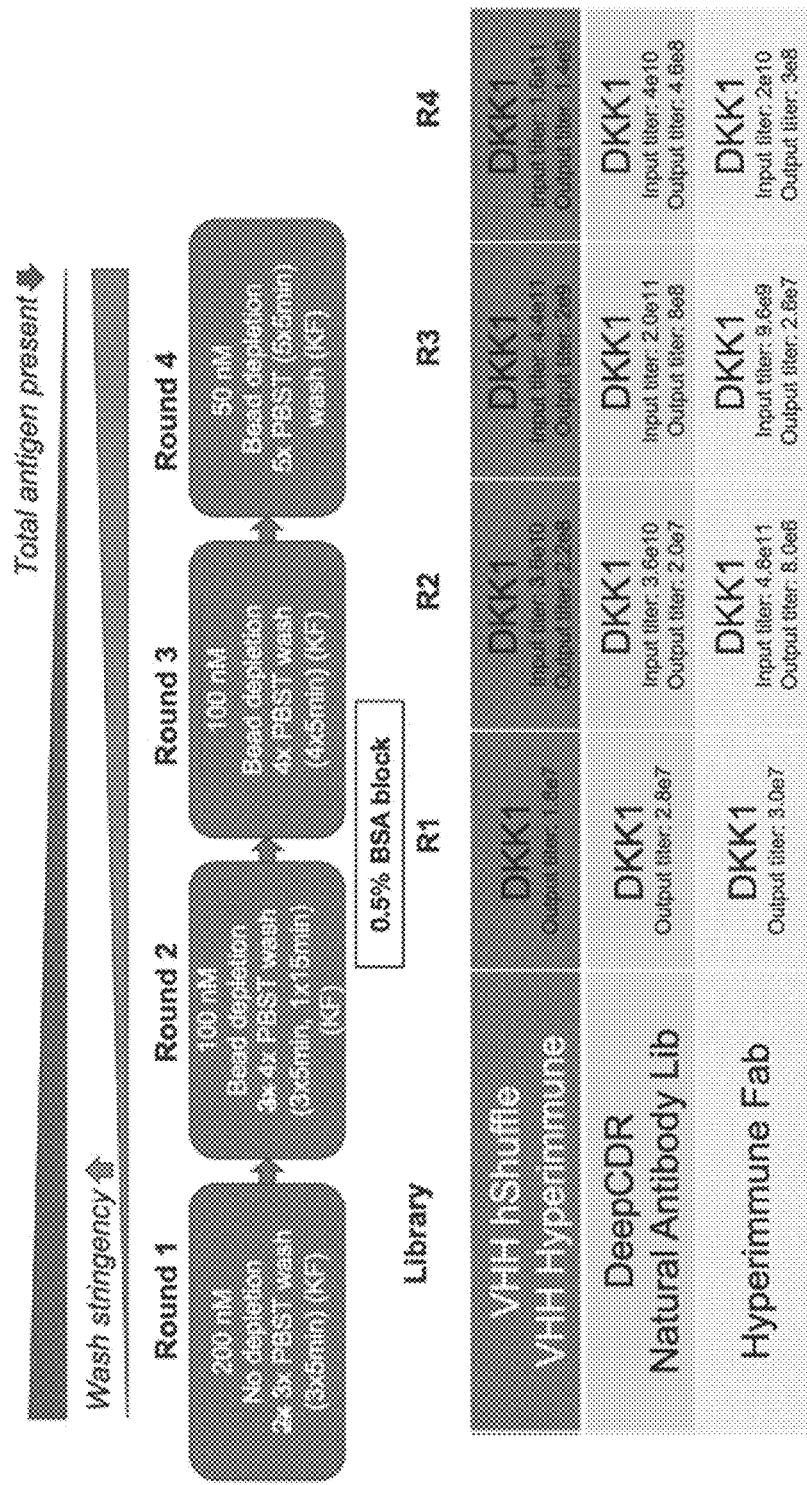
FIG. 21 depicts a schematic of the panning rounds for DKK1 antibody production.

This example describes identification of antibodies for DKK1. Phage displayed libraries were panned for biding to DKK1. Panning was performed as shown in FIG. 21.

Carterra kinetics results showed that VHH-Fc hits bind with high affinity to DKK1 (FIGS. 12A-12D).

Figure 13:
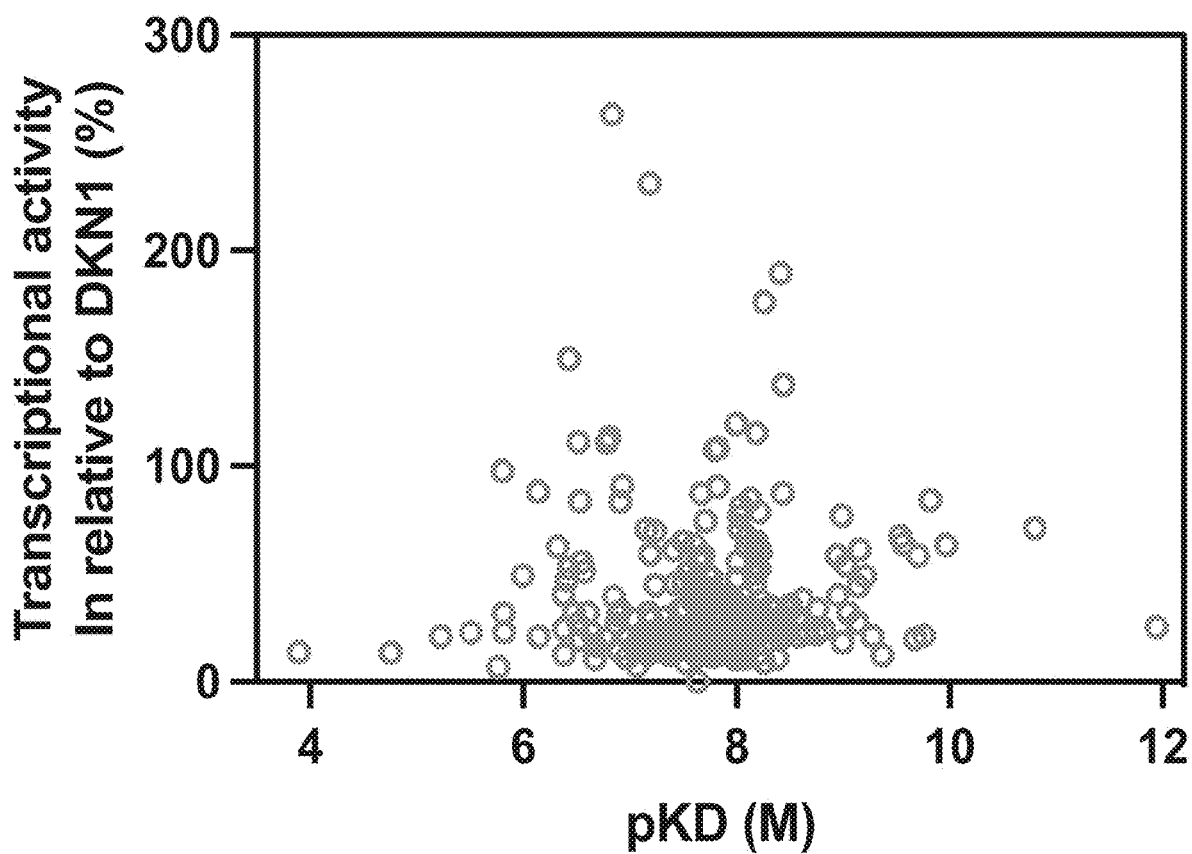
FIG. 13 depicts the results of a TCF/LEF reporter (Wnt signaling) assay. Wnt signaling activation is plotted with SPR binding affinity.

FIG. 13 shows the results of a TCF/LEF reporter (Wnt signaling) assay. Wnt signaling activation was plotted with SPR binding affinity.

Figure 14A:
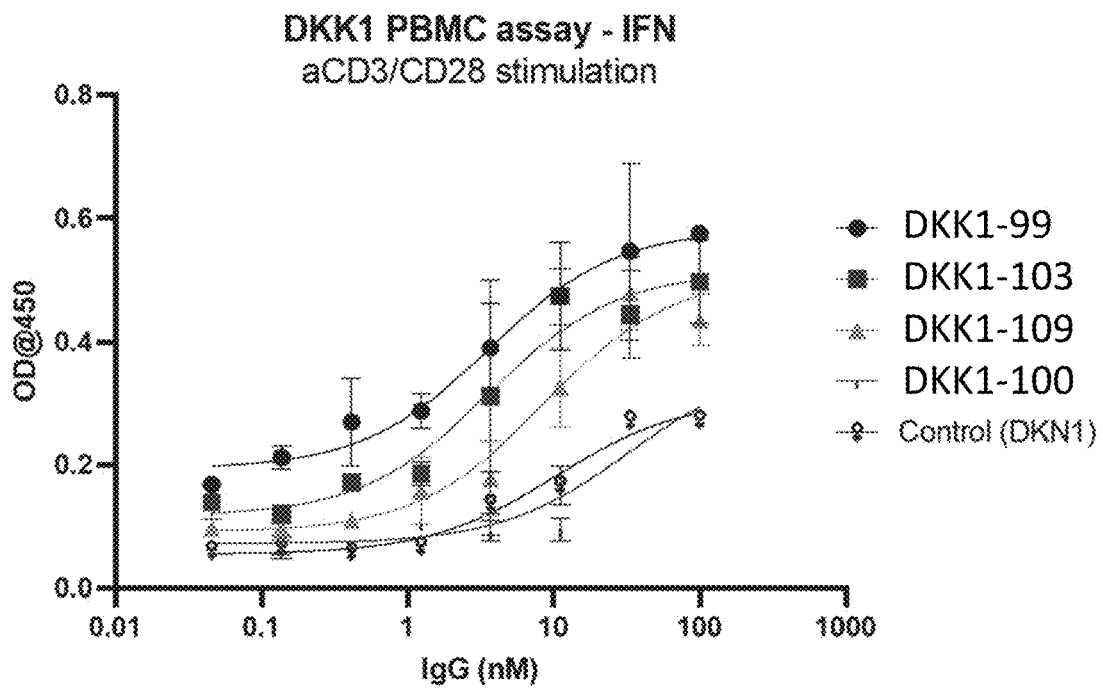
FIGS. 14A-14D depict in vitro primary immune cell activation.
Figure 14B:
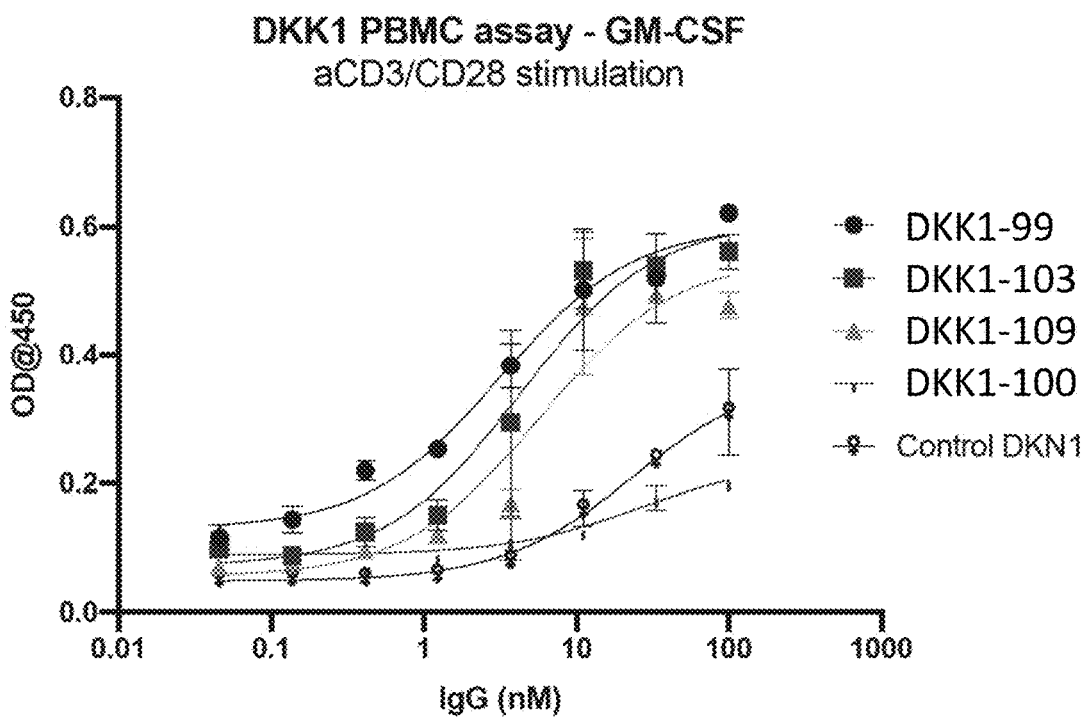
Figure 14C:
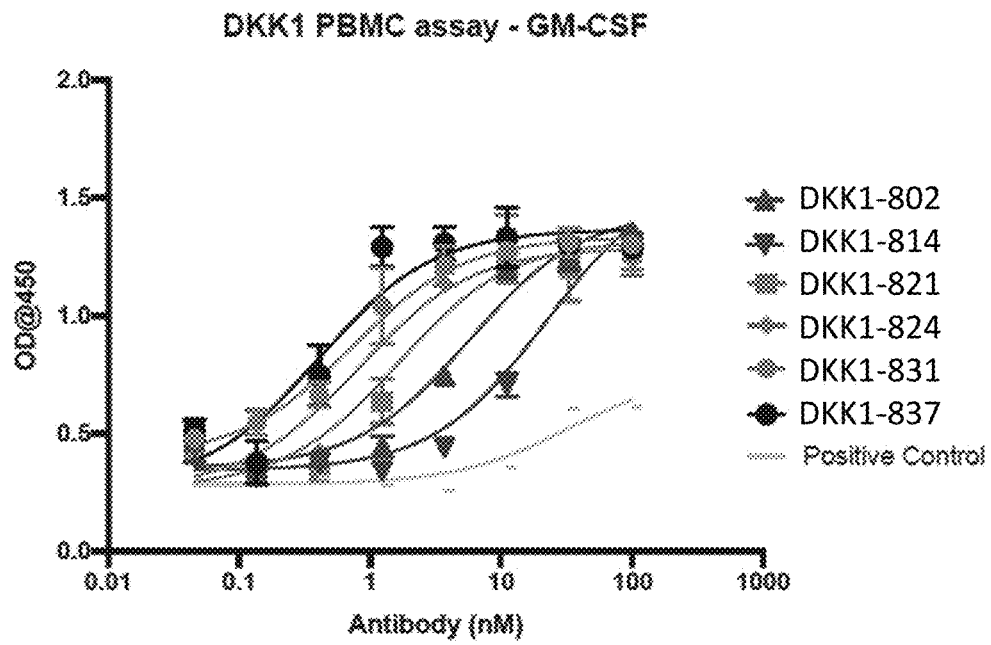
Figure 14D:
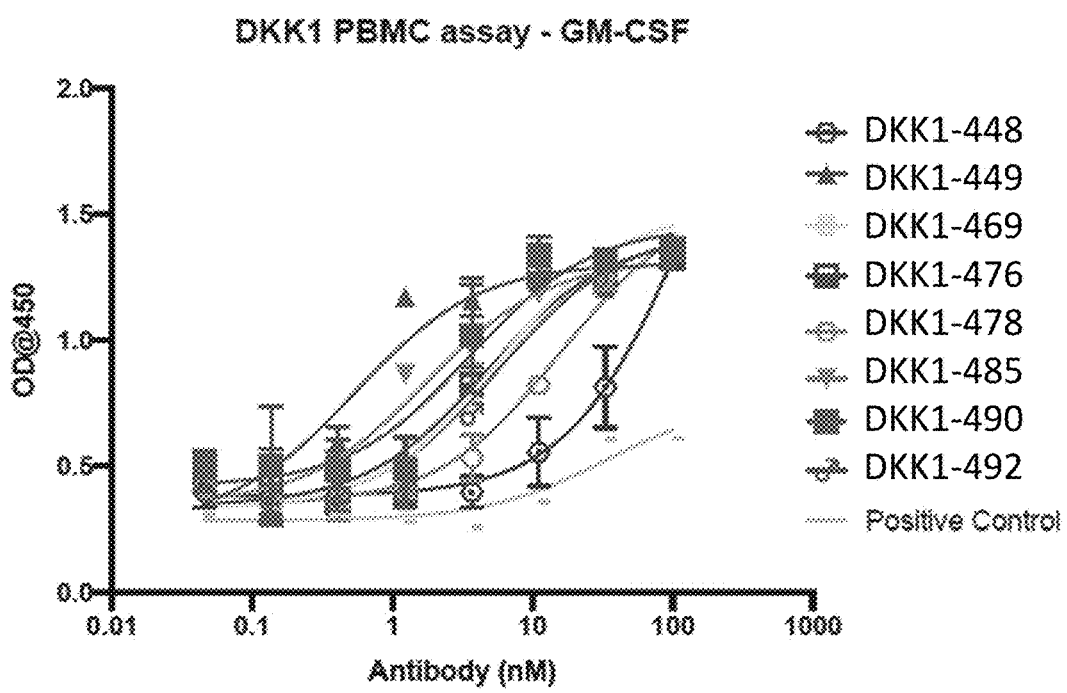

FIGS. 14A-14B show the results of an immune cell activation assay.

Figure 15A:
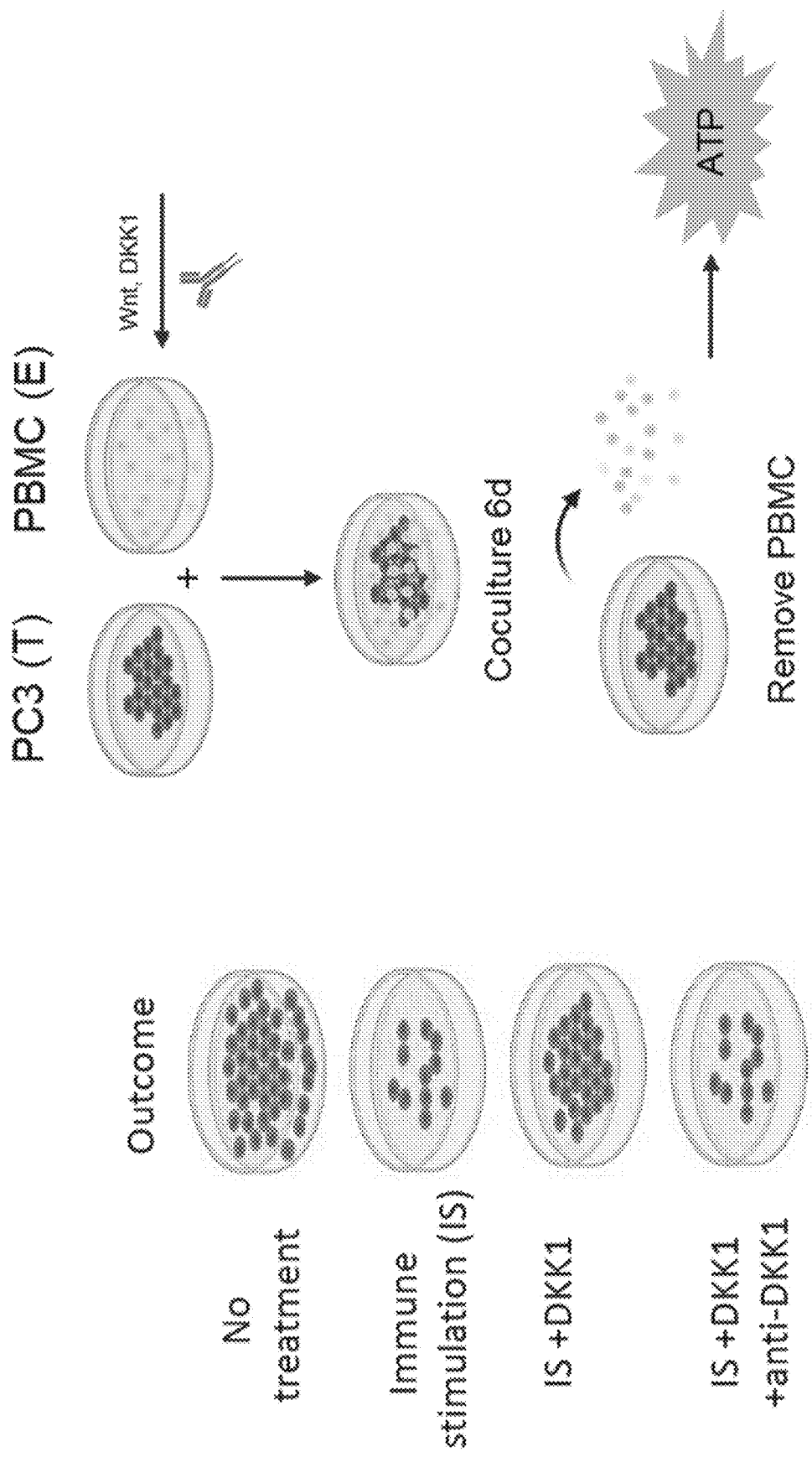
FIG. 15A depicts the outcomes of a tumor killing assay. Activated immune cells kill PC3, while hDKK1 treatment inhibits cytotoxicity.
Figure 15B:
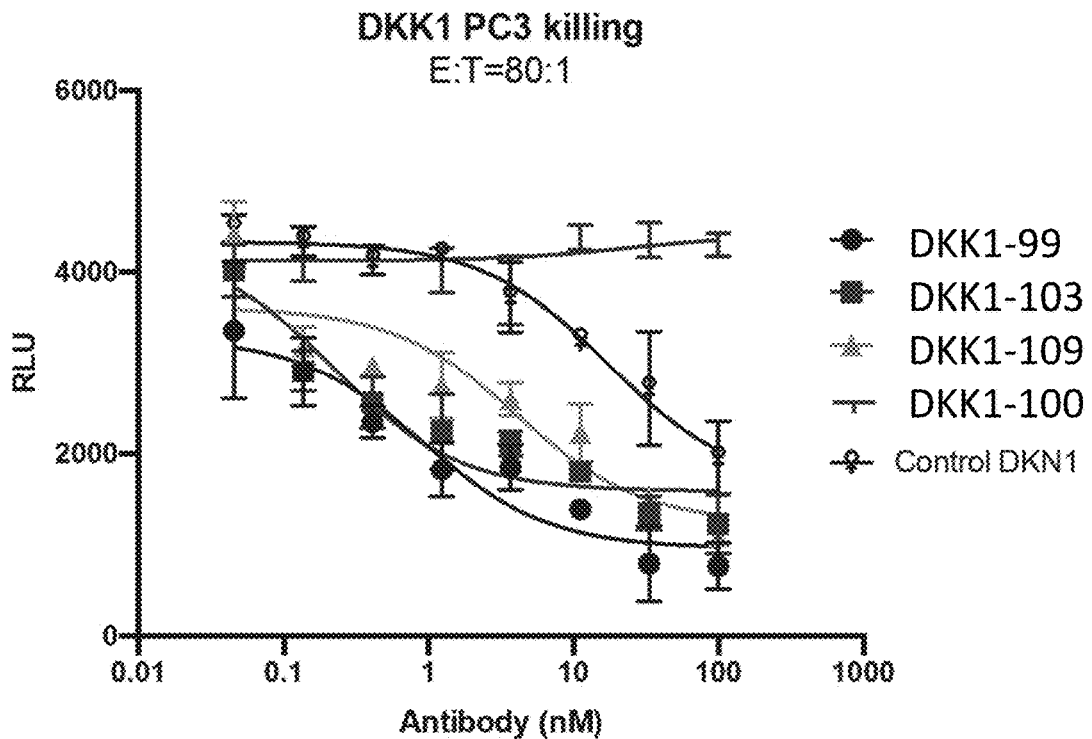
FIG. 15B depicts a graph of the results of a tumor killing assay.
Figure 15C:
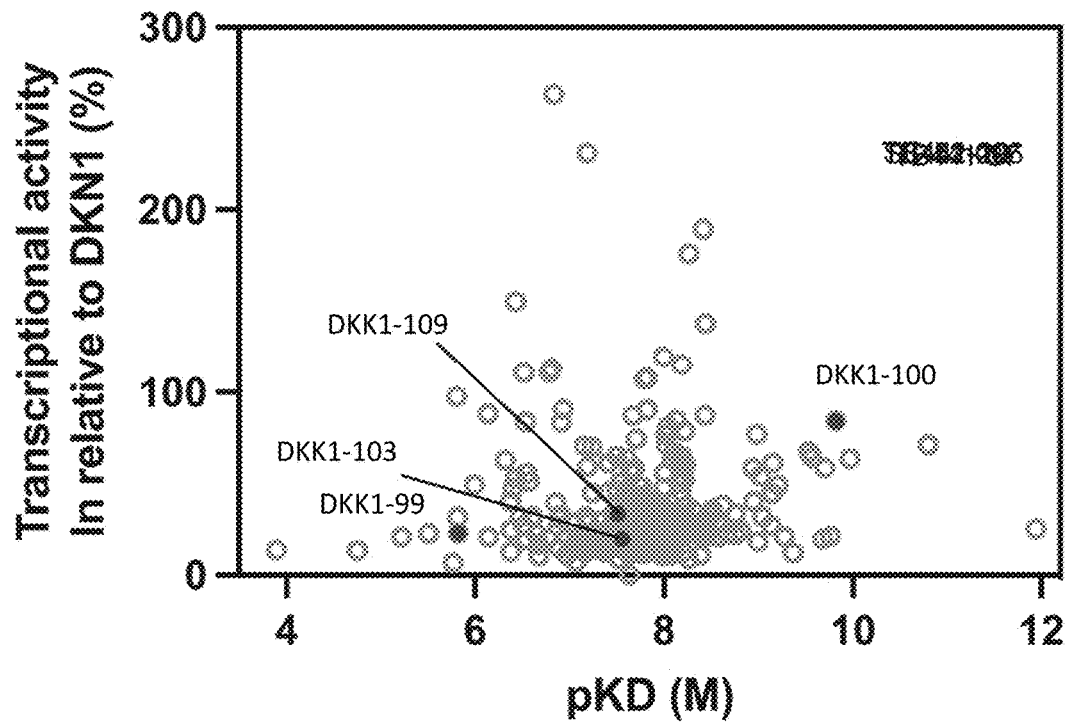
FIG. 15C highlights specific hits from the tumor killing assay that were also found in the TCF/LEF reporter (Wnt signaling) assay.
Figure 15D:
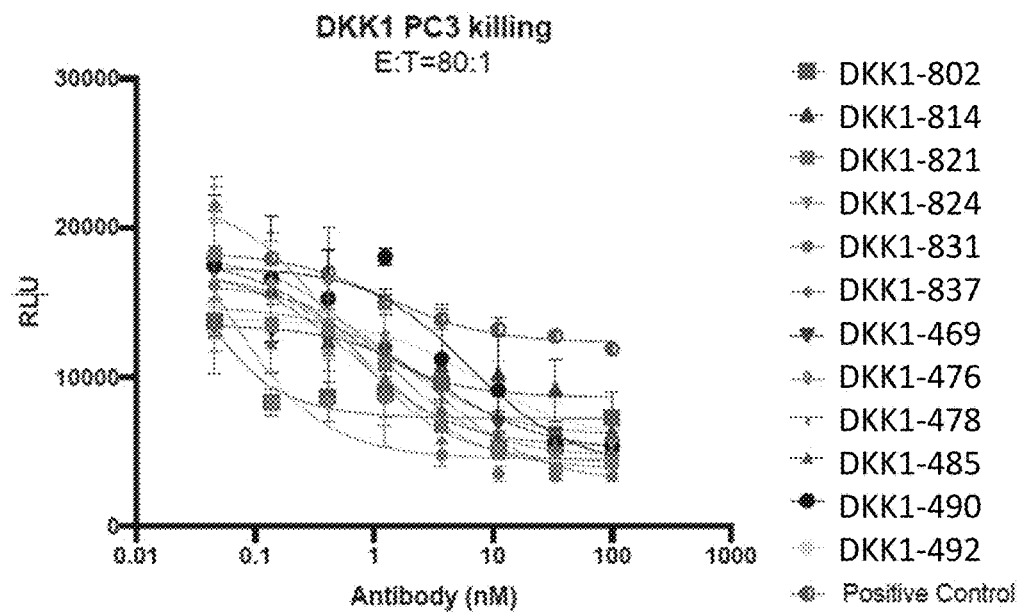
FIG. 15D shows that ML synthetic library and ML from VHH library restore the cytotoxicity potency when DKK1 leads block the interaction of hDKK1 to the receptor.
Figure 15E:
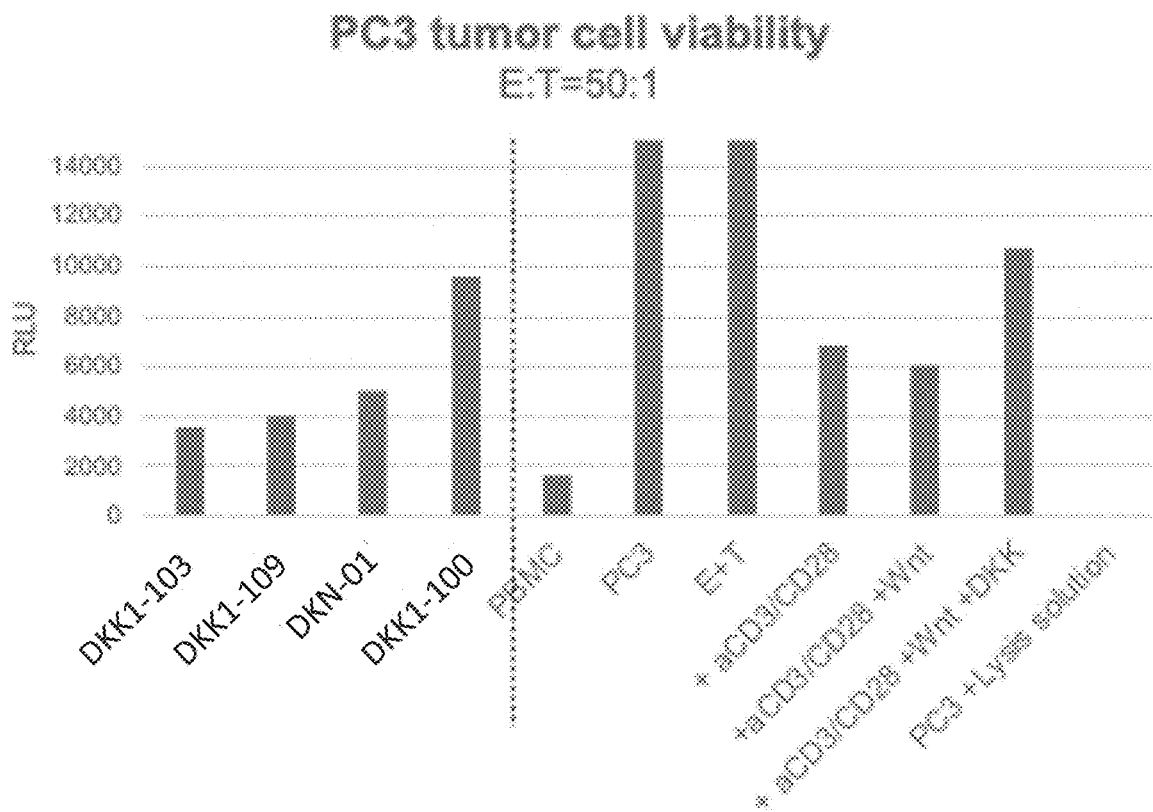
FIG. 15E shows PC3 tumor cell viability results.
Figure 15F:
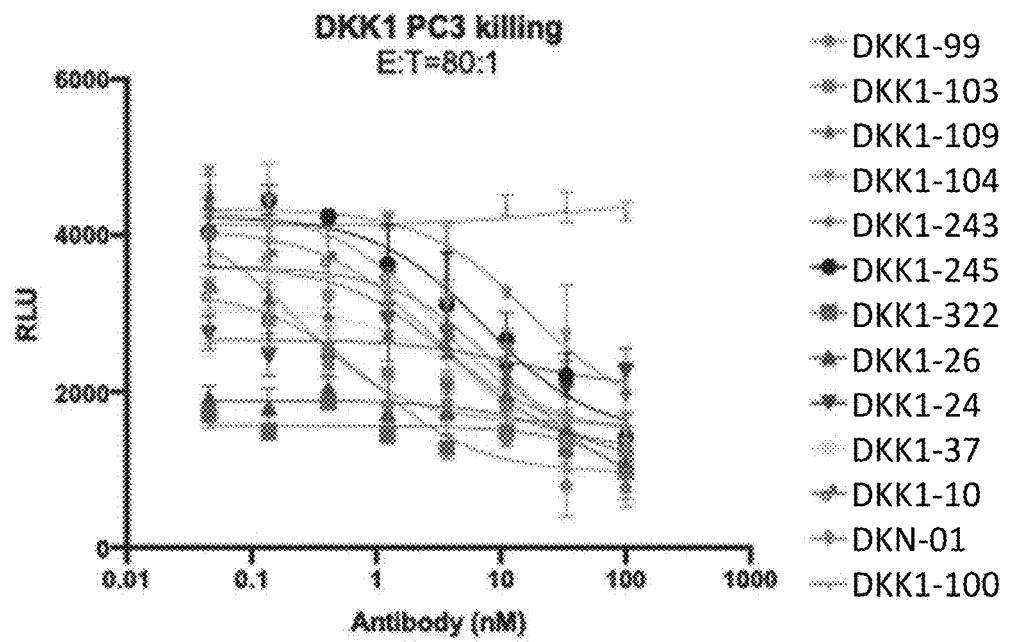
FIG. 15F shows top clones in a PC3 cytotoxicity assay.
Figure 15G:
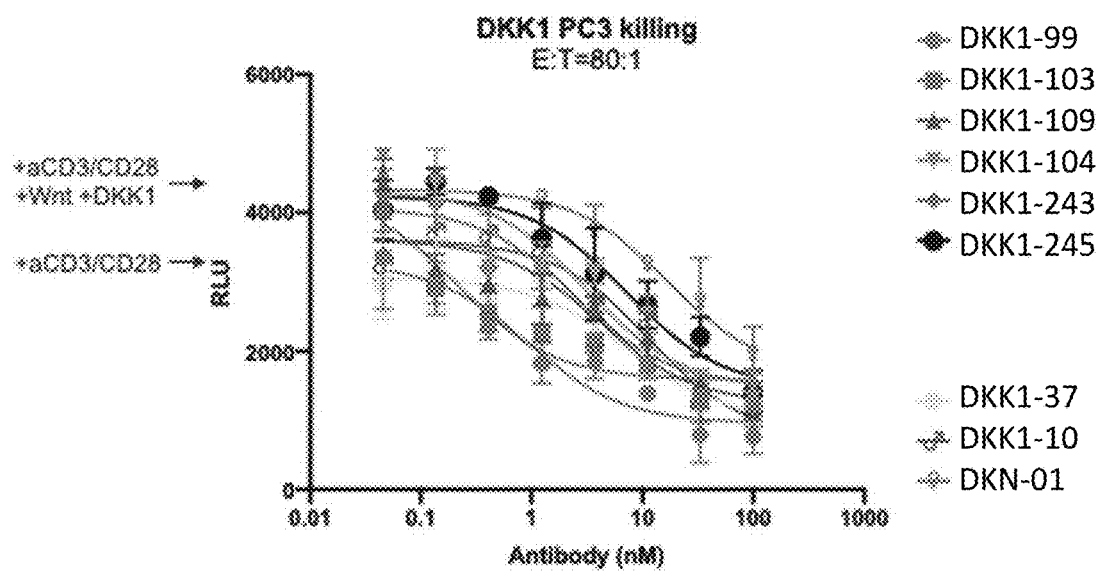
FIG. 15G shows a subset of the top clones in a PC3 cytotoxicity assay.

A tumor cell killing assay was performed as depicted in FIG. 15A. Results showed that high affinity binders that were also Wnt signaling activators were not always the same as strong immune cell activators and tumor killers (FIGS. 15B-15G).

Figure 16:
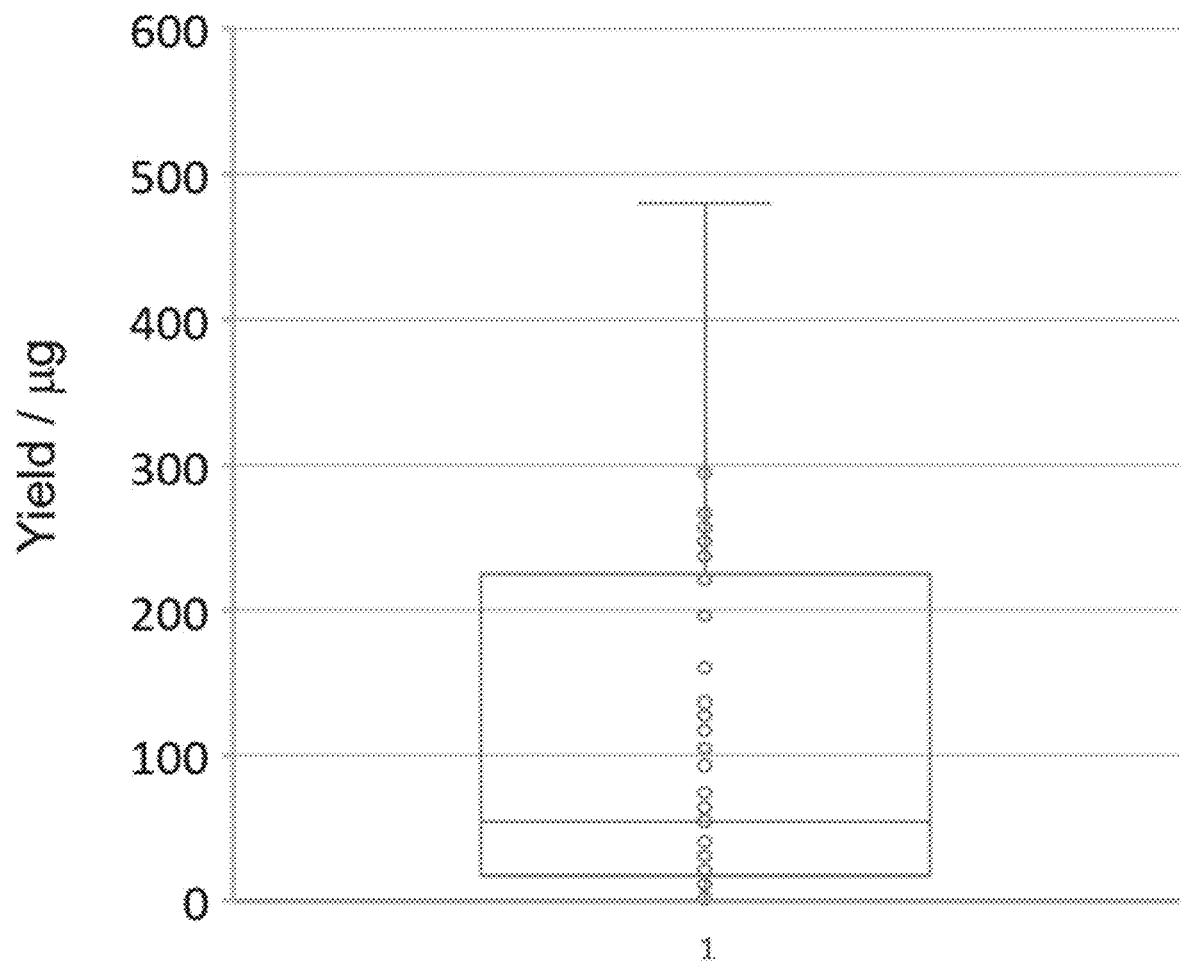
FIG. 16 depicts antibody yield results from 1 mL Expi293 cell culture.

FIG. 16 depicts antibody yield results from 1 mL Expi293 cell culture. It took 31 days to create 113 anti DKK1 VHH-Fc from DNA synthesis to antibody production.

Example 6: Testing DKK1 Antibodies

This example describes assays used to determine the efficacy of anti-DKK1 leads identified in Example 5.

Figure 17B:
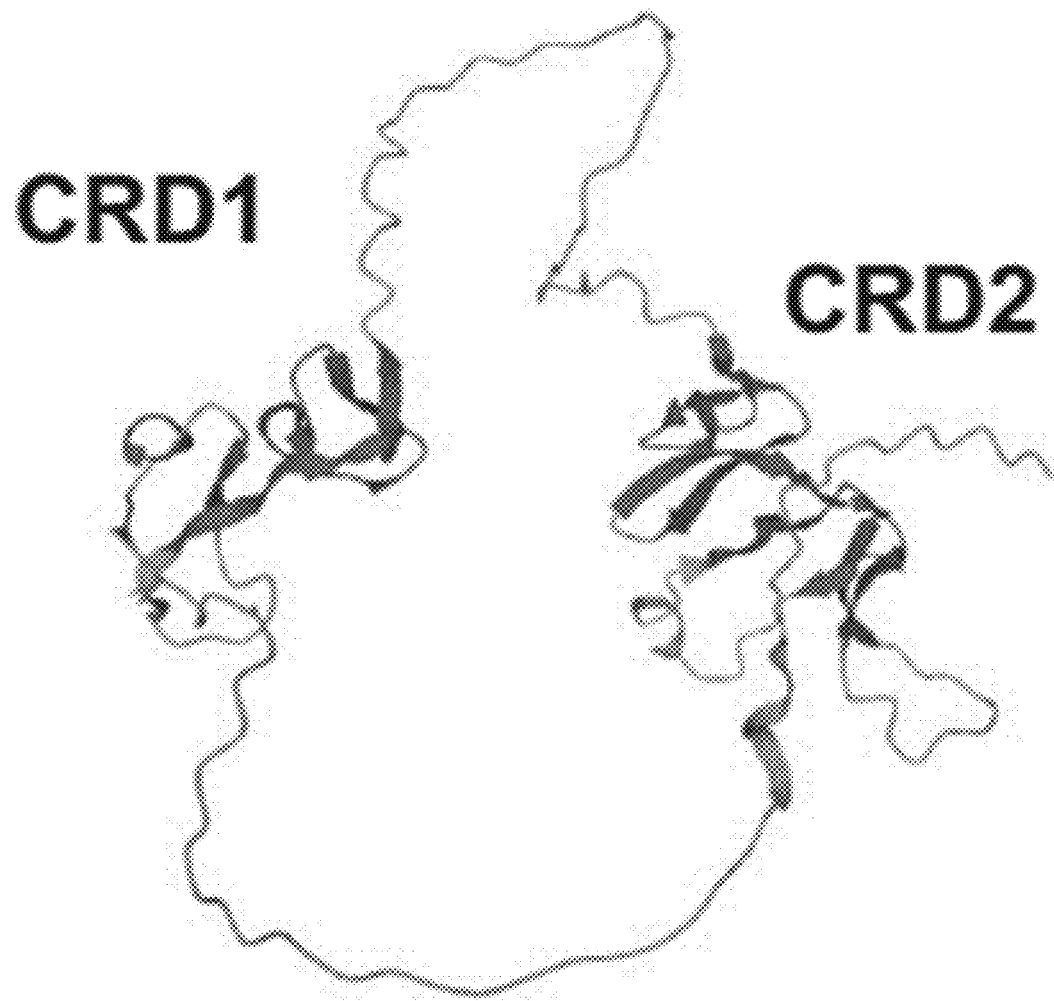

As seen in FIG. 17A, two epitope bins were apparent among top anti-DKK1 leads. These leads bound to two distinct cysteine-rich domains (CRDs) in hDKK1 (CRD1 or CRD2), resulting in different activation pathways (FIGS. 17B-17C).

Figure 18A:
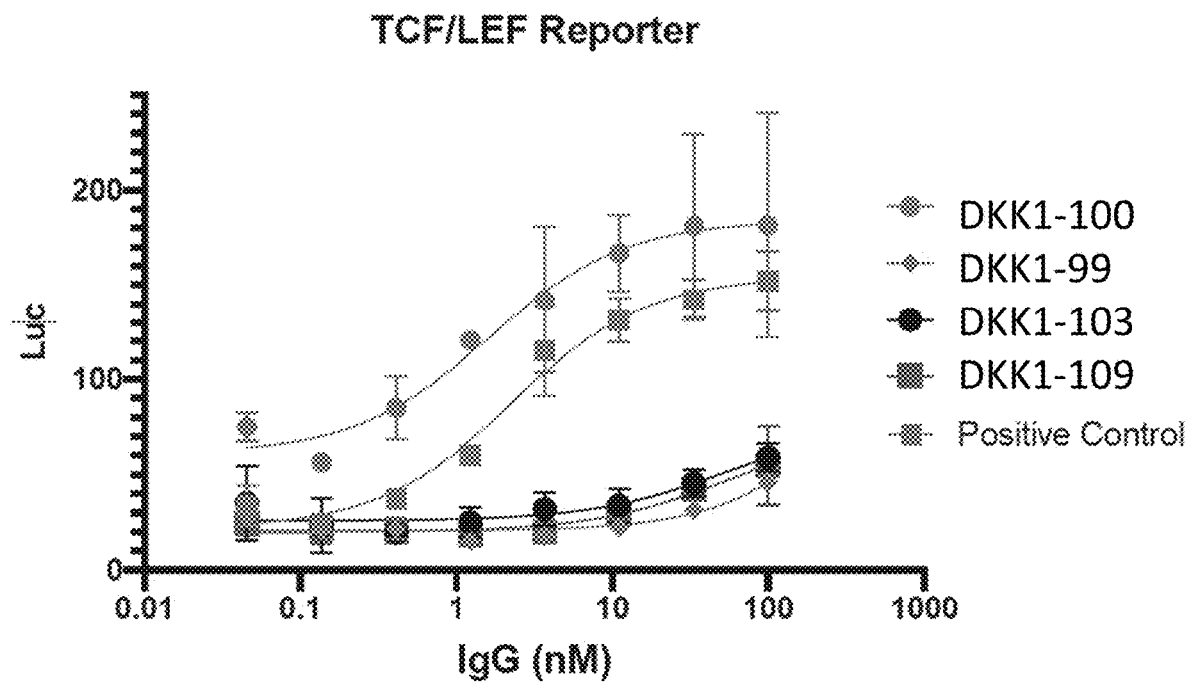
FIGS. 18A-18C depict Wnt TCF/LEF reporter assay screening. Wnt TCF/LEF signaling is blocked by DKK1 binding to LRP5/6. DKK1 leads were screened from a VHH library (FIG. 18A), a ML synthetic library (FIG. 18B), and a ML from VHH library (FIG. 18C).
Figure 18B:
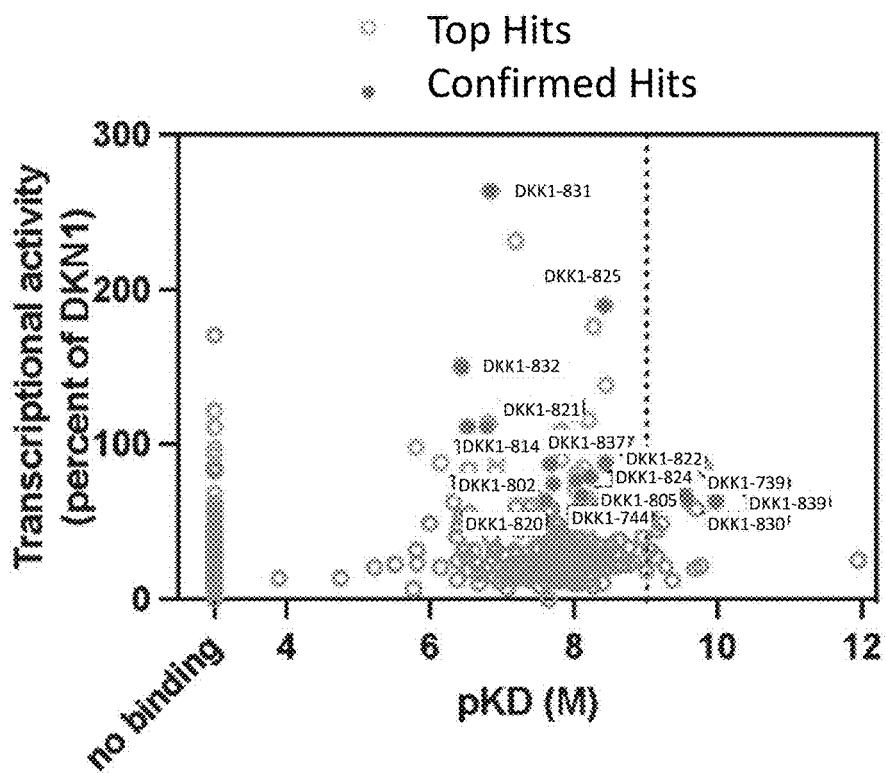
Figure 18C:
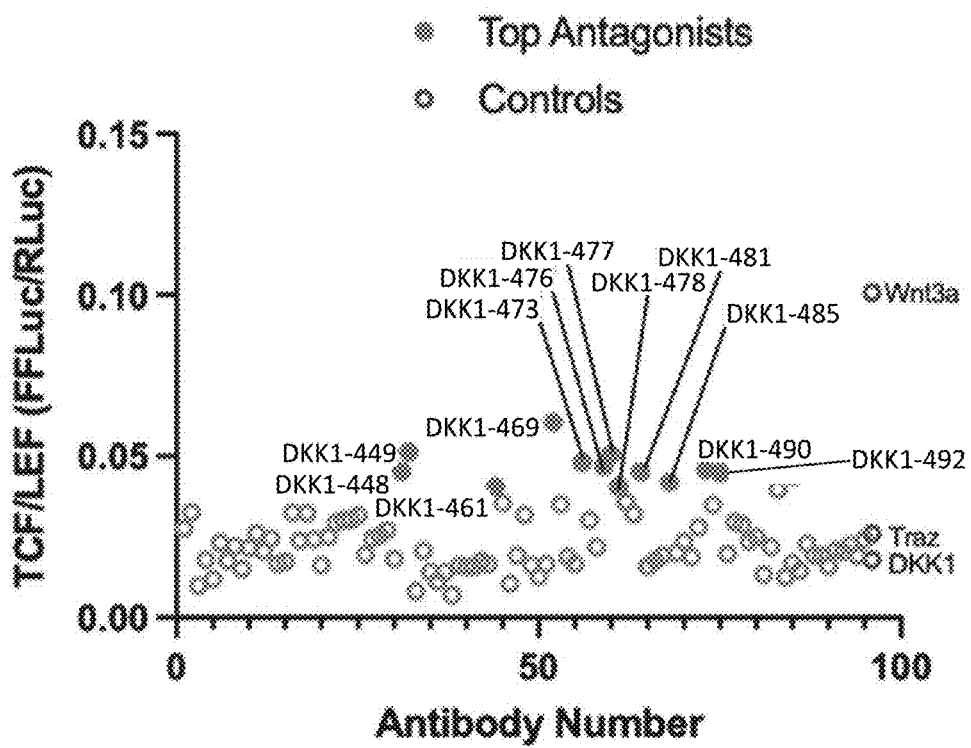

Anti-DKK1 VHH leads were found to block DKK1 binding to the receptor (FIGS. 18A-18C) DKK1 binding to LRP5/6 blocks Wnt TCF/LEF signaling; however anti-DKK1 leads blocked DKK1 binding to the receptor, which resulted in TCF/LEF signal activation.

Figure 19A:
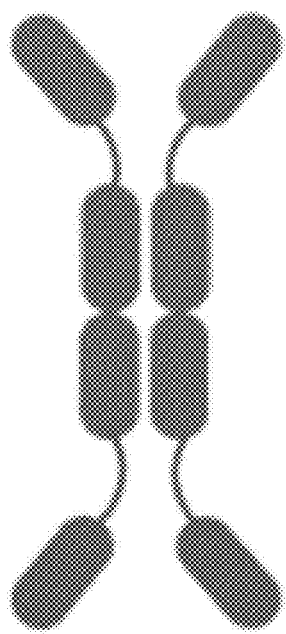
FIGS. 19A-19D depict BsAb functional assays. DKK1-99 binds to DKK1 CRD1 and activates an immune response, while DKK1-100 binds to DKK1 CRD2 and activates Wnt signaling. A bispecific Ab of DKK1-99 and DKK1-100 (FIG. 19A) shows the potency of activating both Wnt (FIG. 19B) and immune response (FIG. 19C).
Figure 19B:
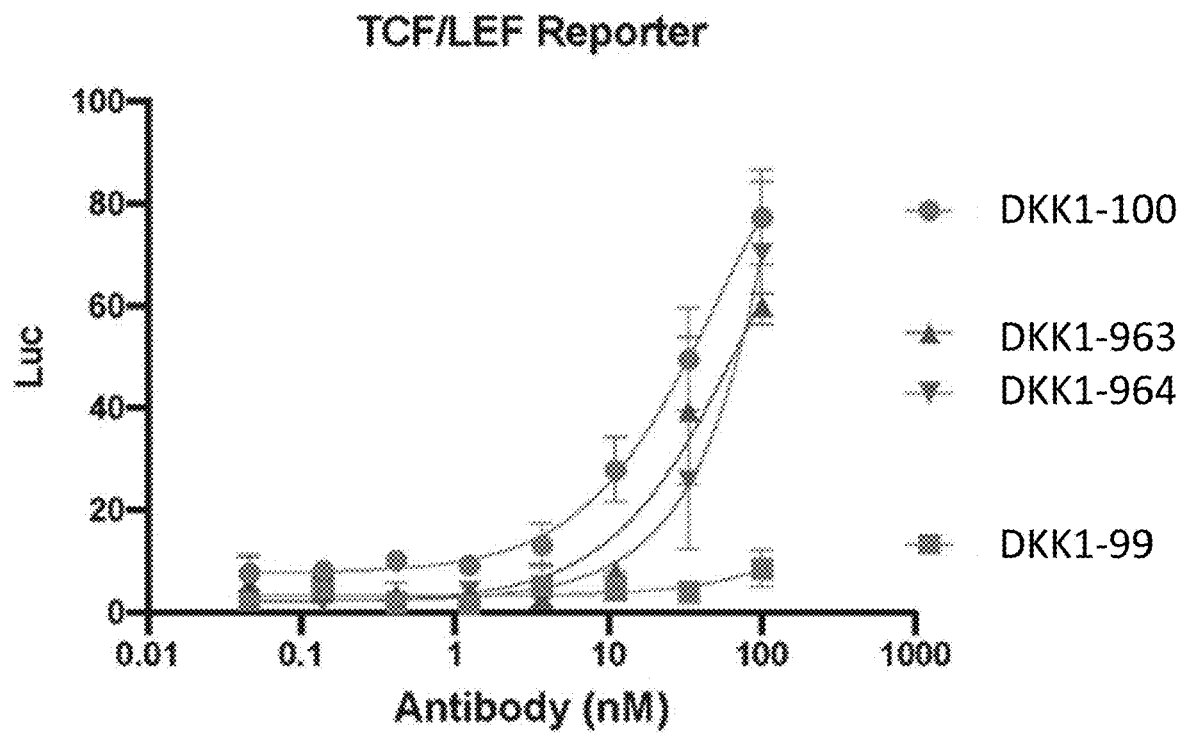
Figure 19C:
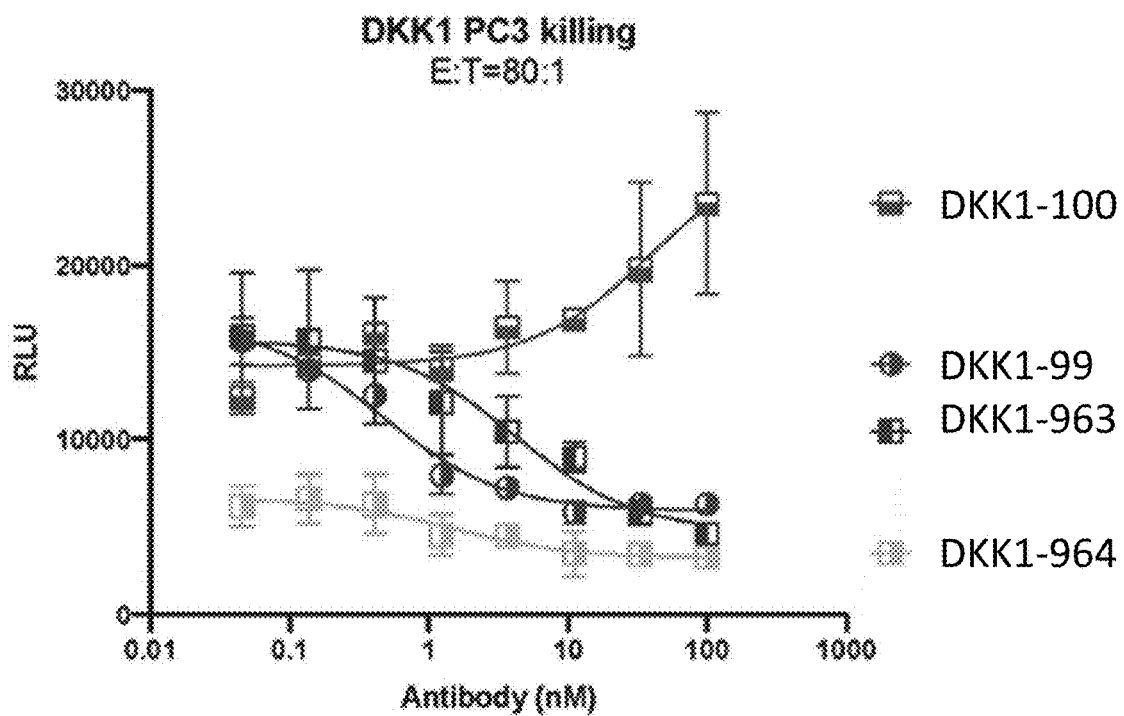
Figure 19D:
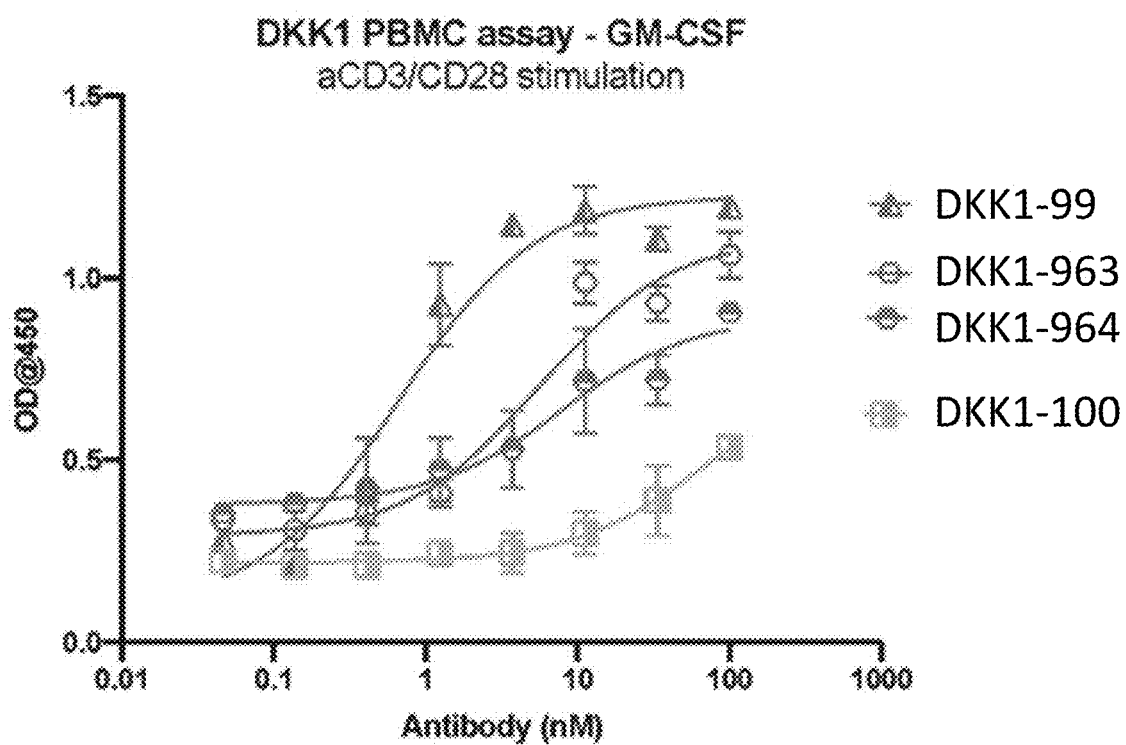
Figure 22A:
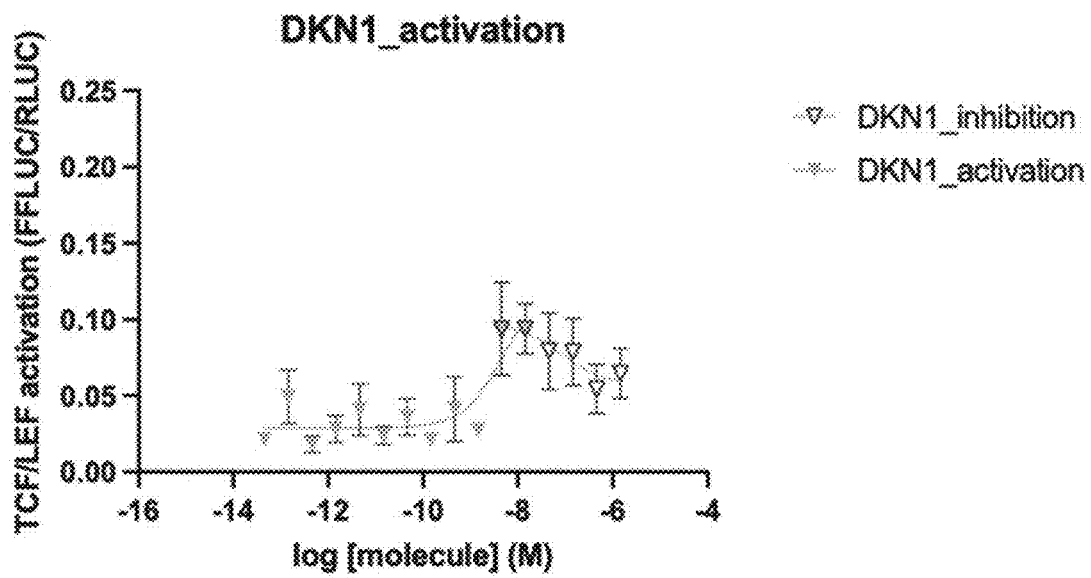
FIGS. 22A-22C show that antagonism of DKK1 inhibition of WNT in TCF/LEF assays is biphasic.
Figure 22B:
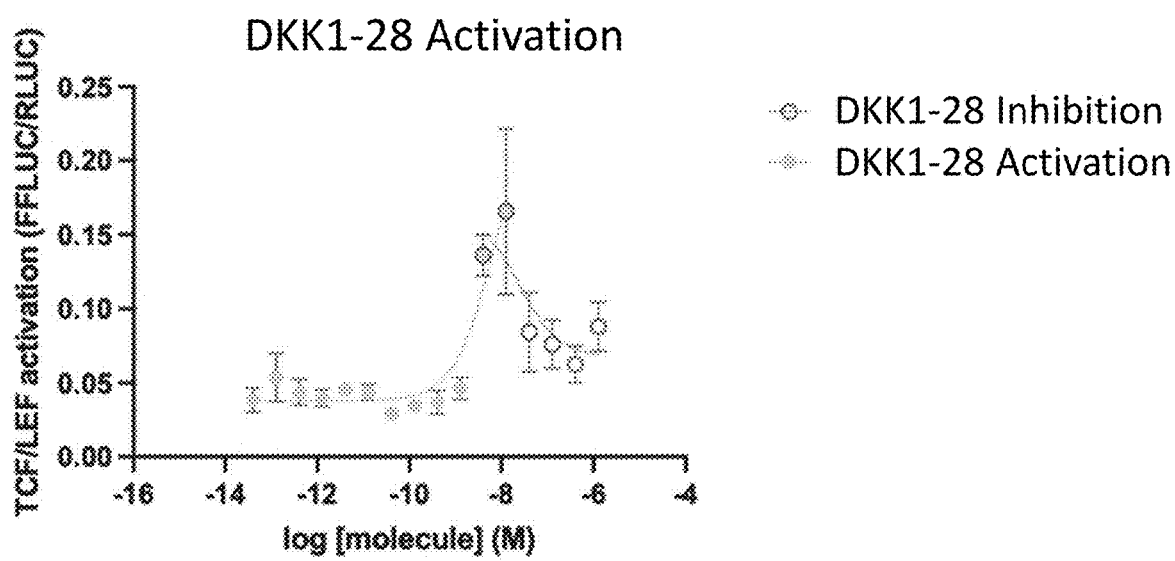
Figure 22C:
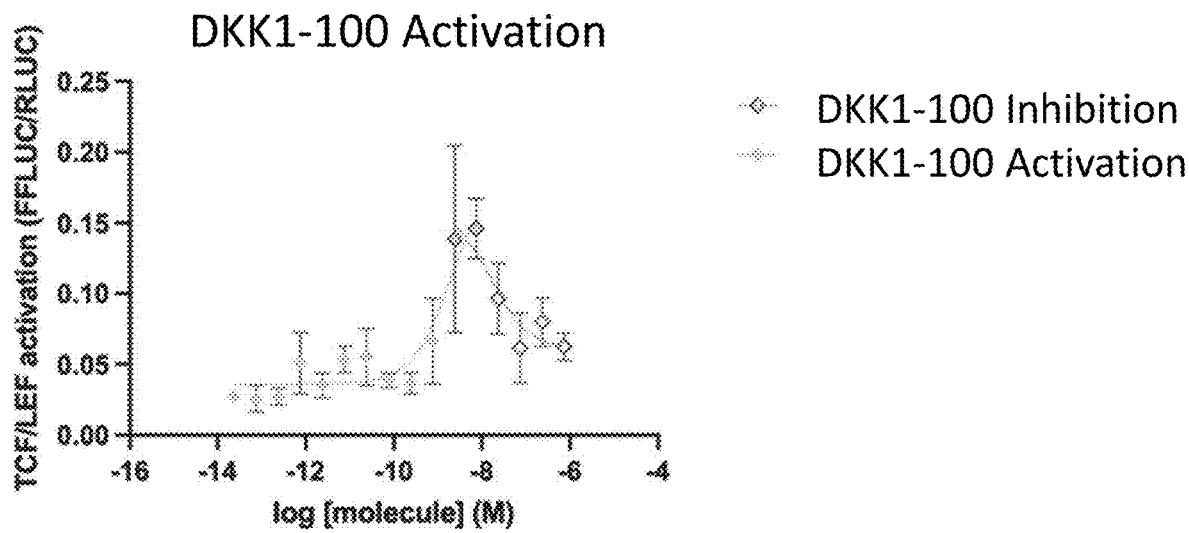
Figure 23A:
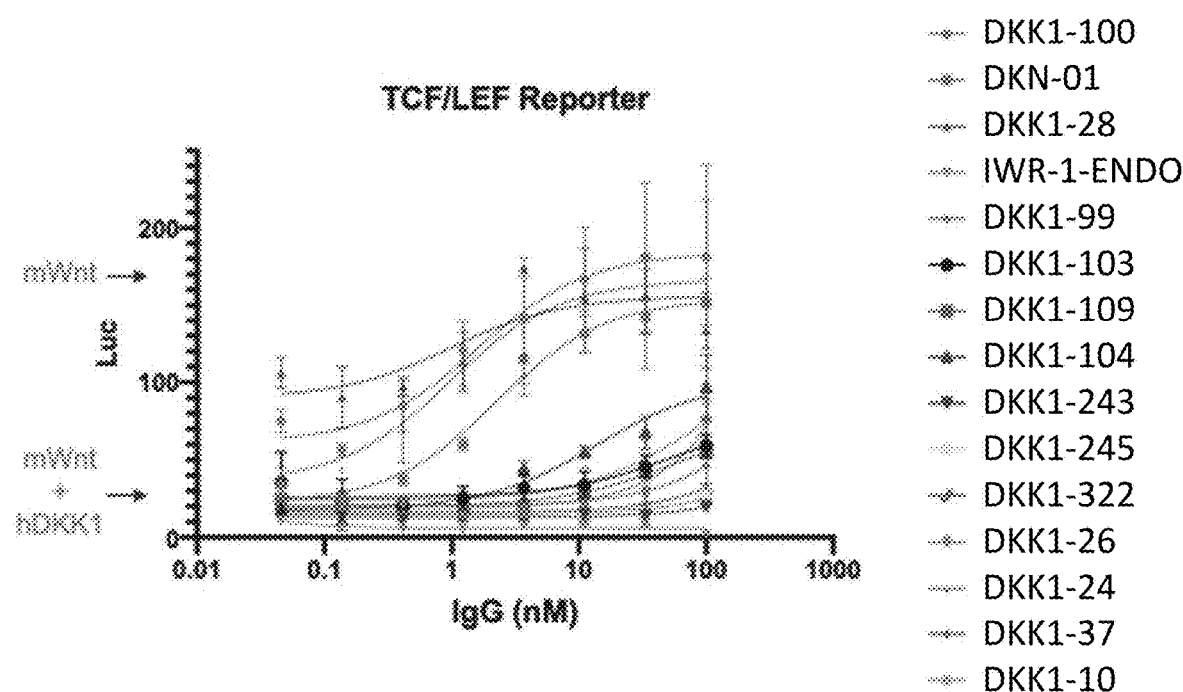
FIG. 23A shows that transient and cell line TCF/LEF reporter rankings match in functional assays.
Figure 23B:
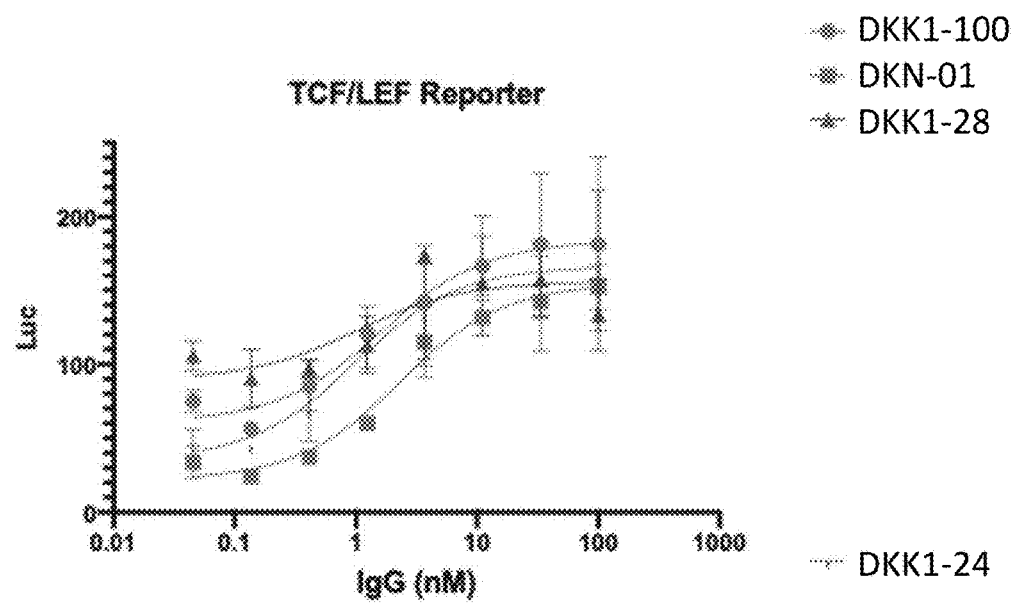
FIG. 23B shows a subset of the results of FIG. 23A.
Figure 24:
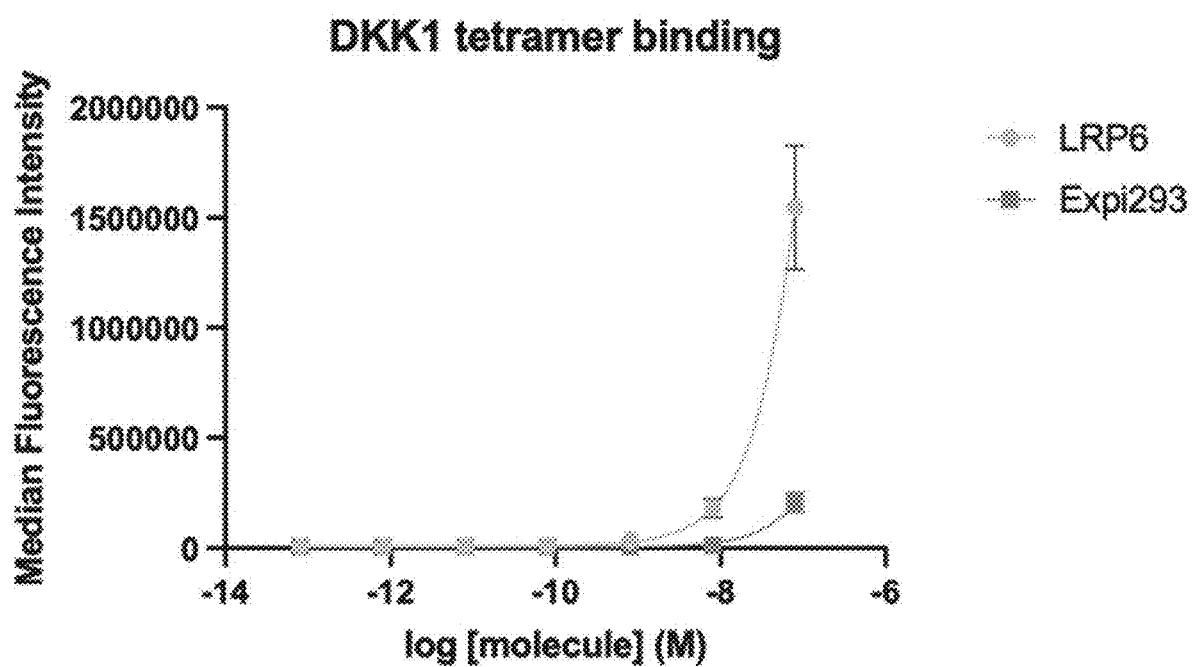
FIG. 24 shows the development of a DKK1/LRP6 binding assay.
Figure 25A:
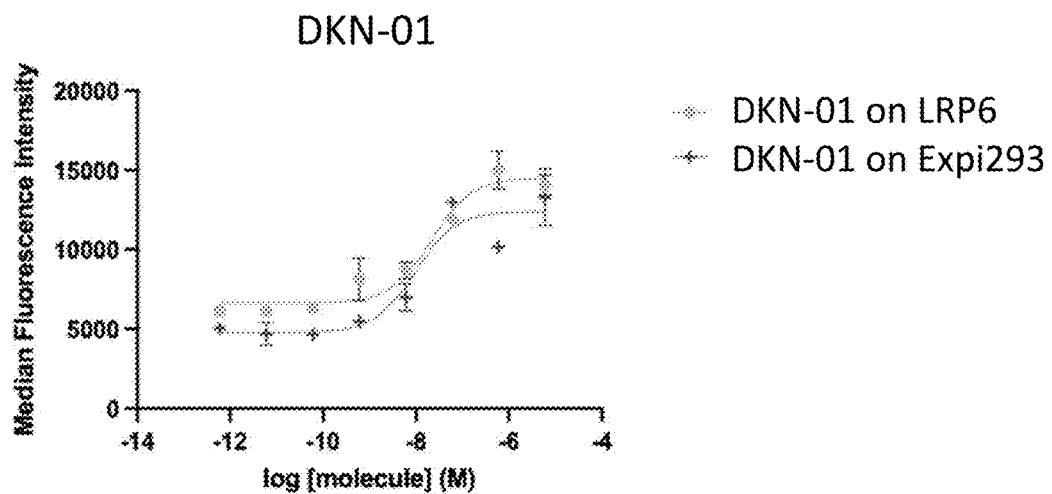
FIGS. 25A-25C show that functional antagonists DKN-01 (FIG. 25A), DKK1-100 (FIG. 25B), and DKK1-28 (FIG. 25C) enhance DKK1 binding to LRP6.
Figure 25B:
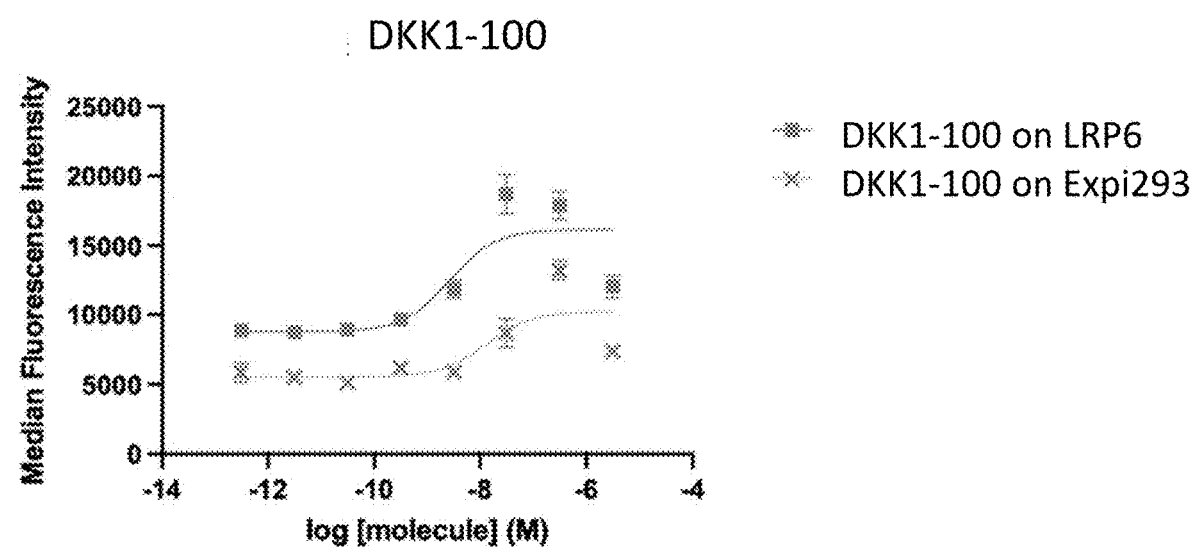
Figure 25C:
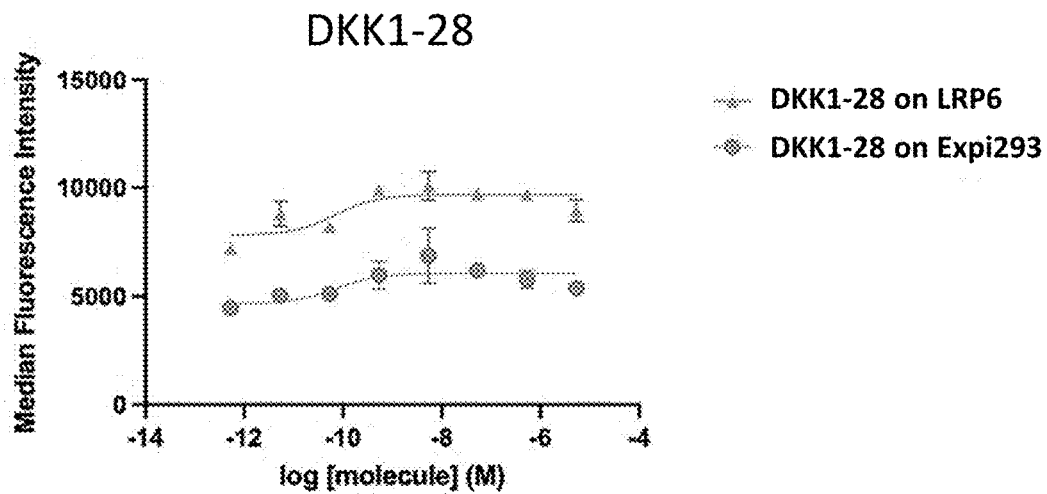
Figure 26A:
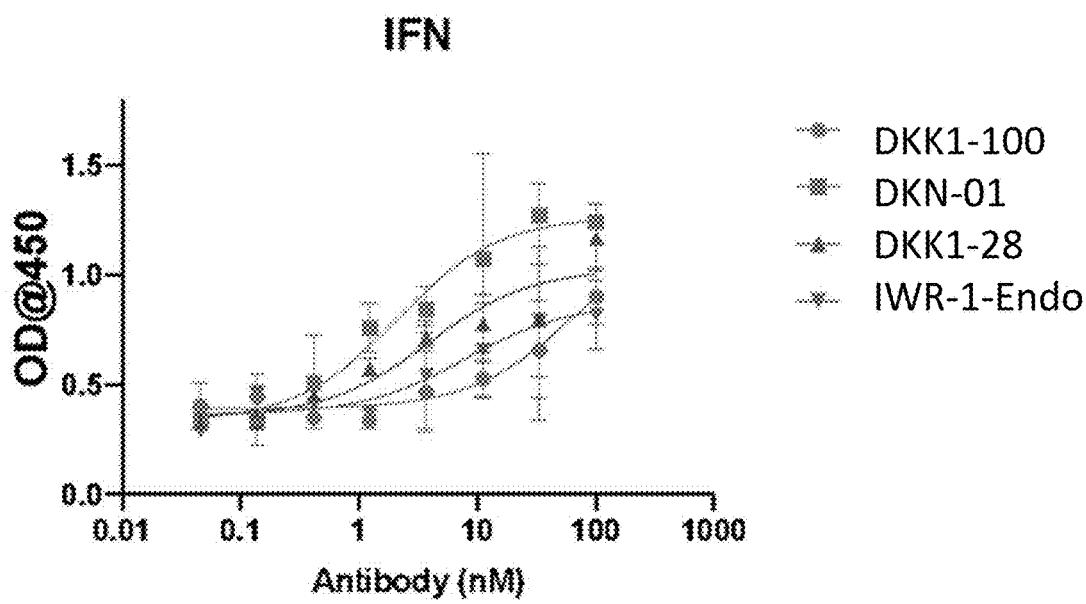
FIGS. 26A-26B show the results of primary immune cell reactivation assays.
Figure 26B:
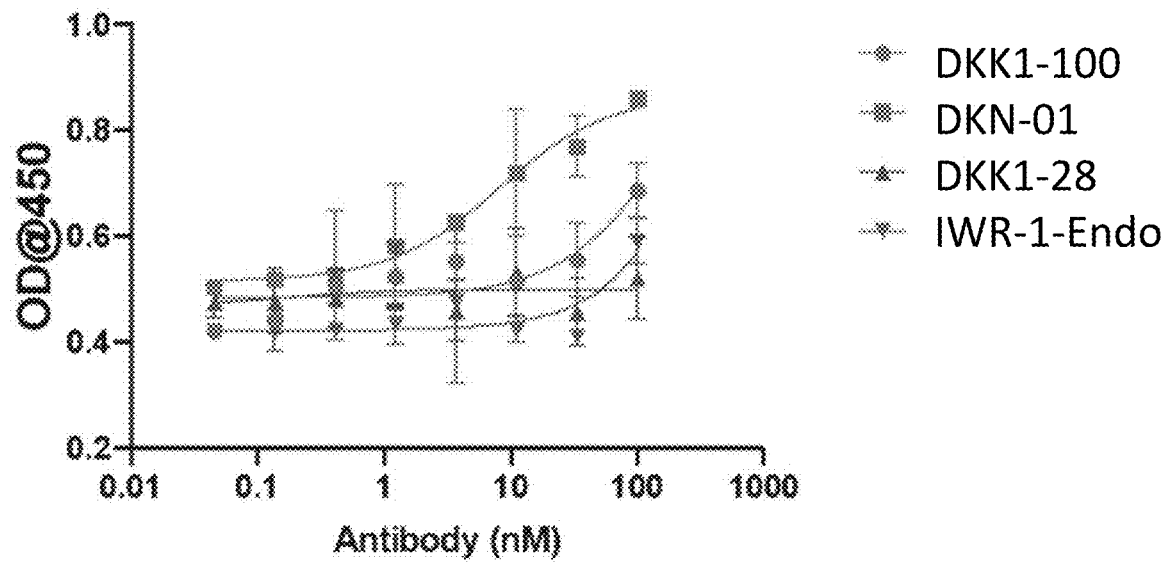
Figure 27A:
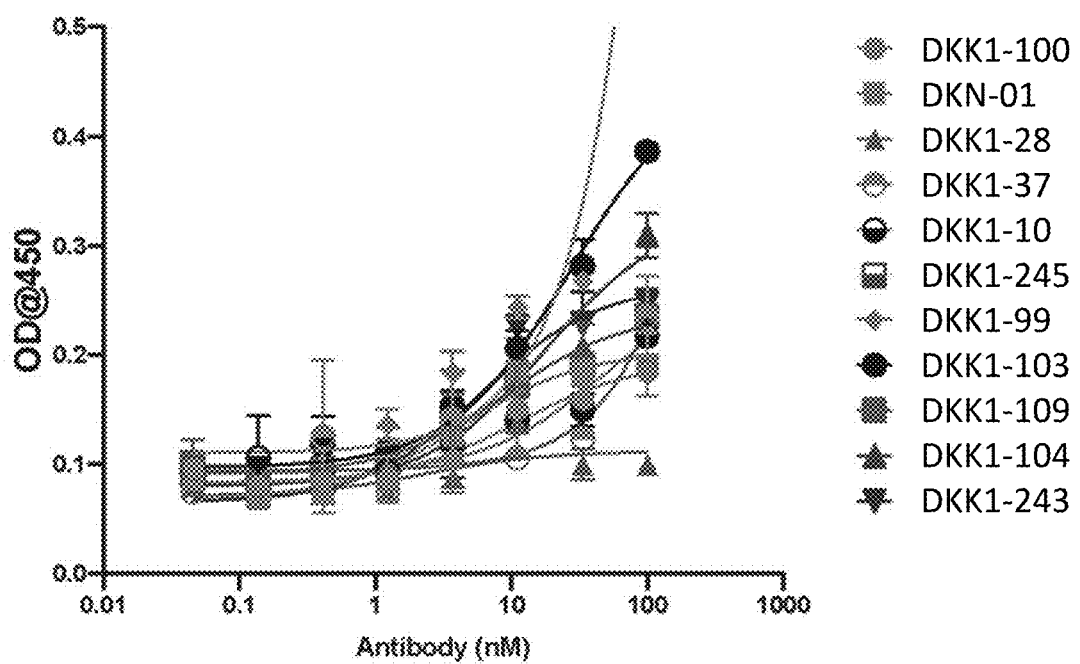
FIG. 27A shows the results for primary NK cell activation.
Figure 27B:
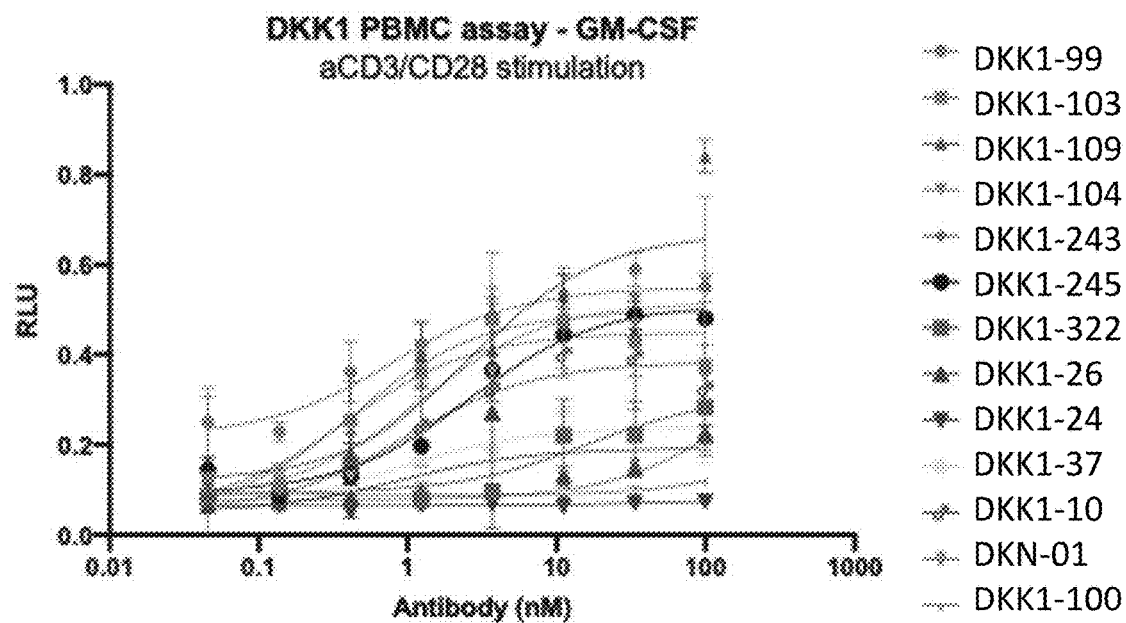
FIG. 27B shows immune cell activation assay results for top clones.
Figure 27C:
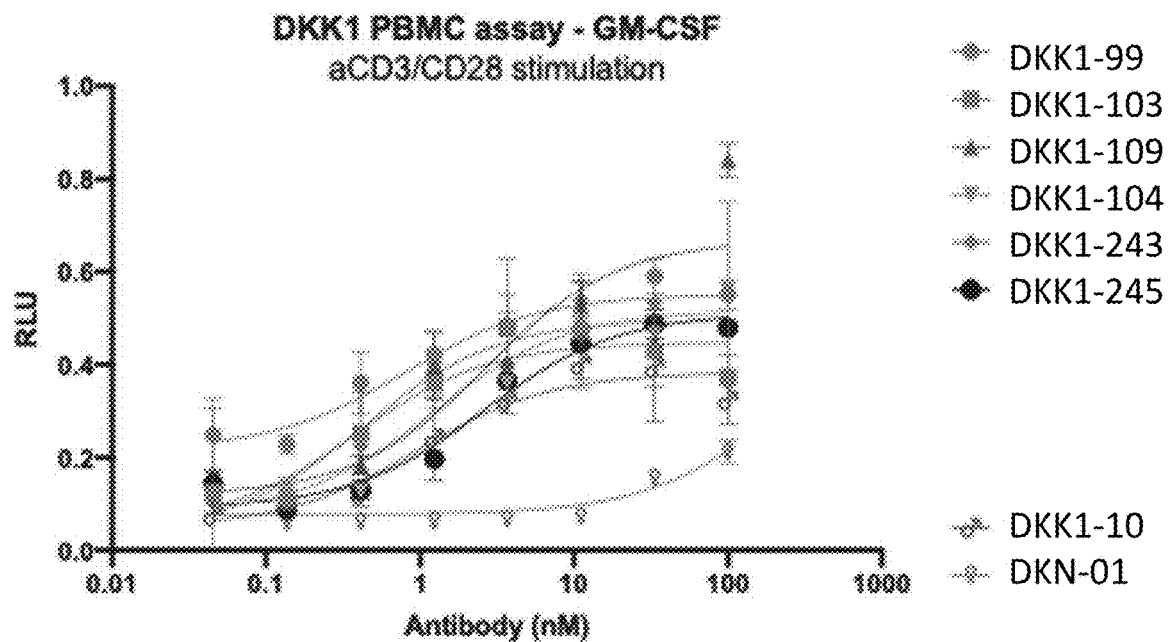
FIG. 27C shows a subset of the results of FIG. 27B.

Dual functional activity of DKK1-100 and DKK1-99 was tested in signaling assays, immune cell activation, and tumor cell killing (FIGS. 19A-19C). FIGS. 22A-22C showed that antagonism of DKK1 inhibition of WNT in TCF/LEF assays is biphasic. Transient and cell line TCF/LEF reporter rankings were found to match in functional assays (FIGS. 23A-23B).

Figure 28A:
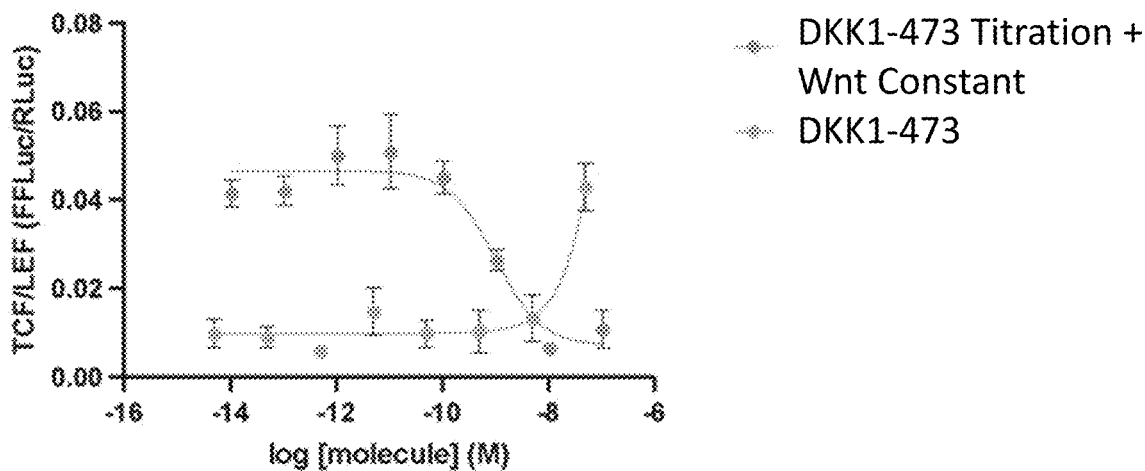
FIG. 28A-28D show the identification of antagonists DKK1-473 (FIG. 28A), DKK1-478 (FIG. 28B), DKK1-477 (FIG. 28C), and DKK1-448 (FIG. 28D) through signaling titration assays.
Figure 28B:
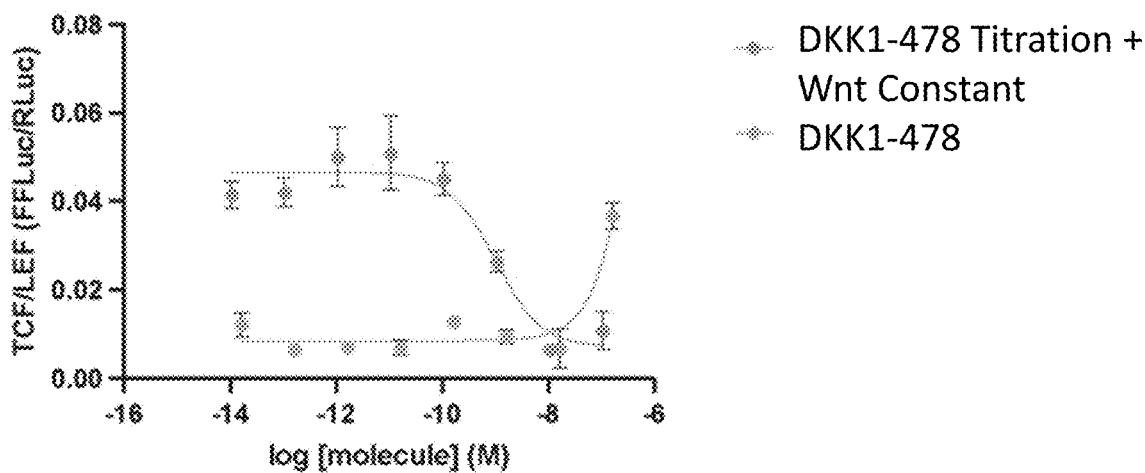
Figure 28C:
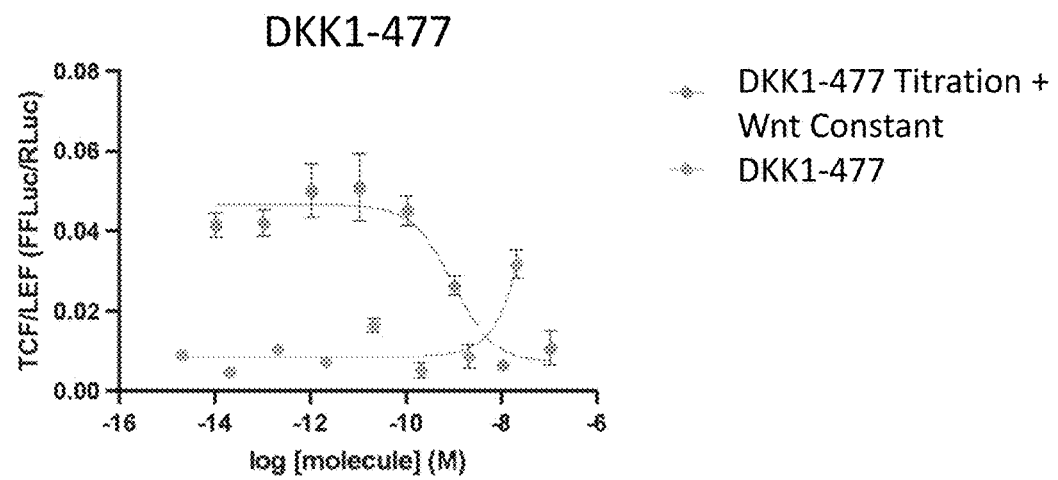
Figure 28D:
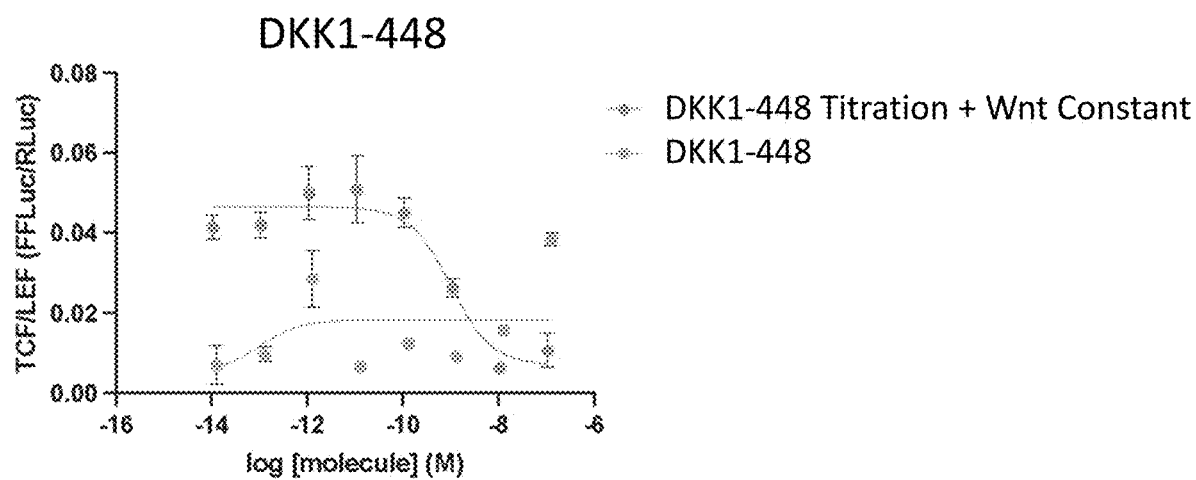
Figure 29A:
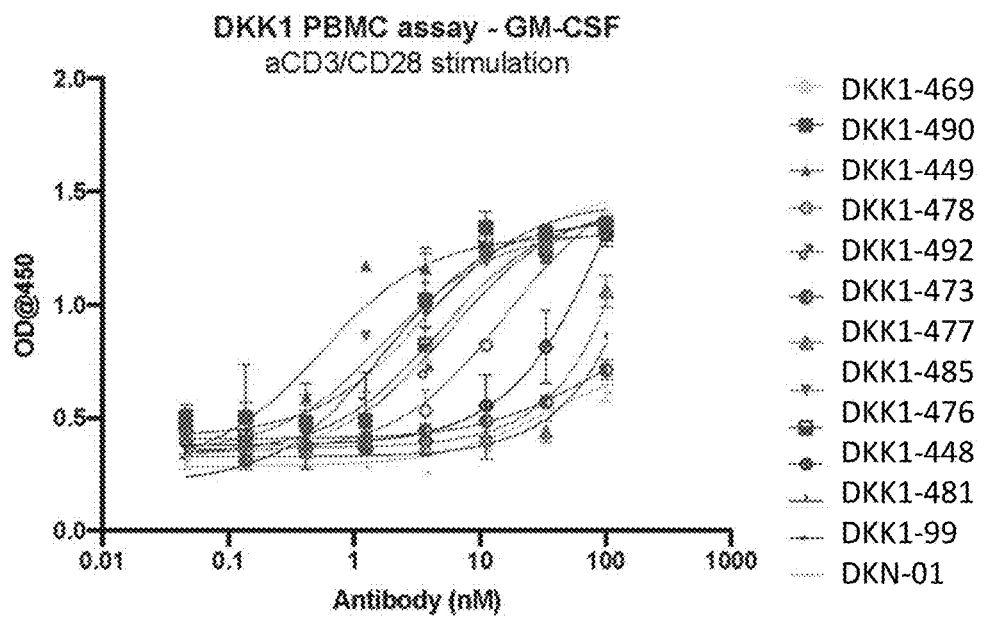
FIG. 29A shows the results of an immune assay.
Figure 29B:
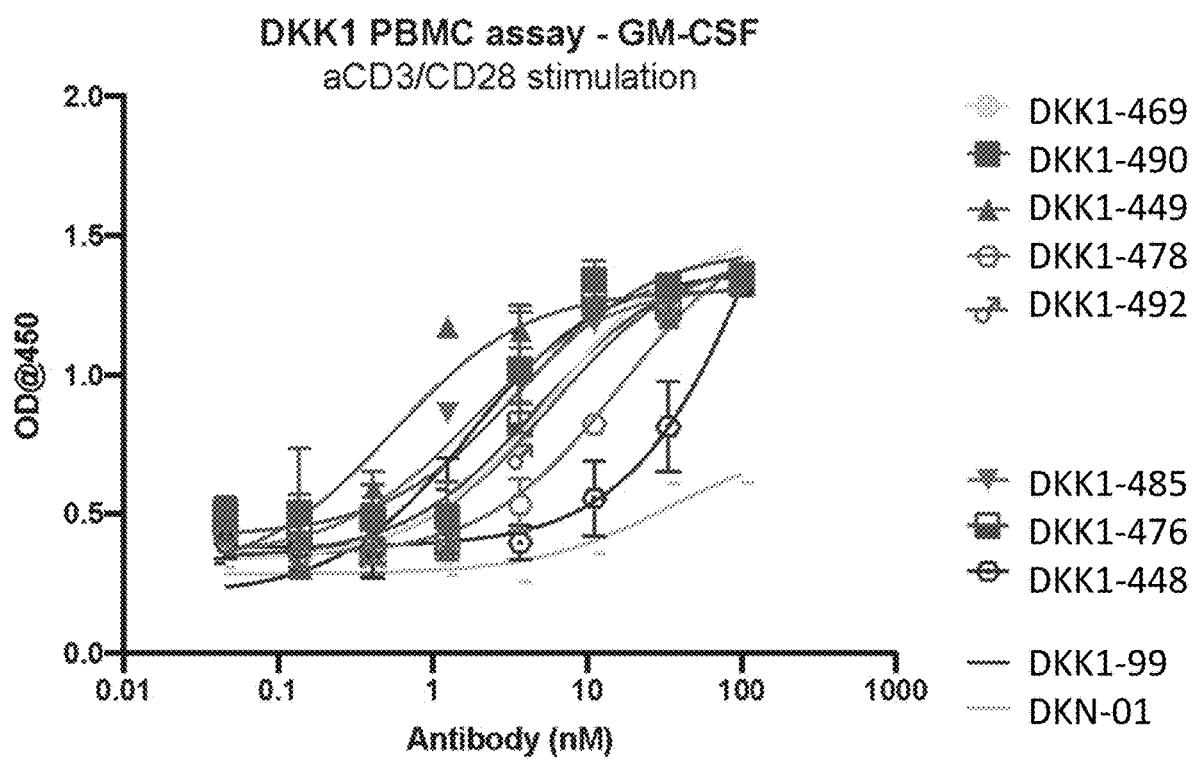
FIG. 29B shows a subset of the results of FIG. 29A.

DKK1 antibodies were tested for binding to LRP6 (FIG. 24 and FIGS. 25A-25C) and for activation of immune cells (FIGS. 26A-26B and FIGS. 27A-27C). Signaling titration assays were used to identify antagonists (FIGS. 28A-28D). Additional immune assays were also performed (FIGS. 28A-28B).

Example 7: In Vivo Efficacy of DKK1 Antibodies

Figure 20A:
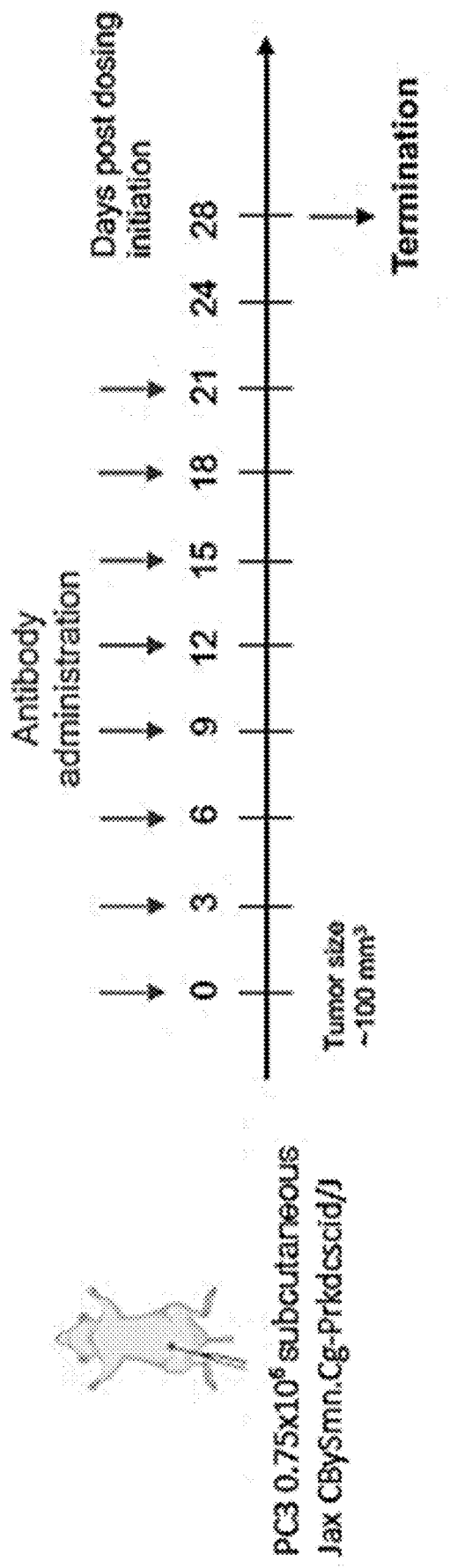
FIGS. 20A-20D depict DKK1 leads in tumor regression.
Figure 20B:
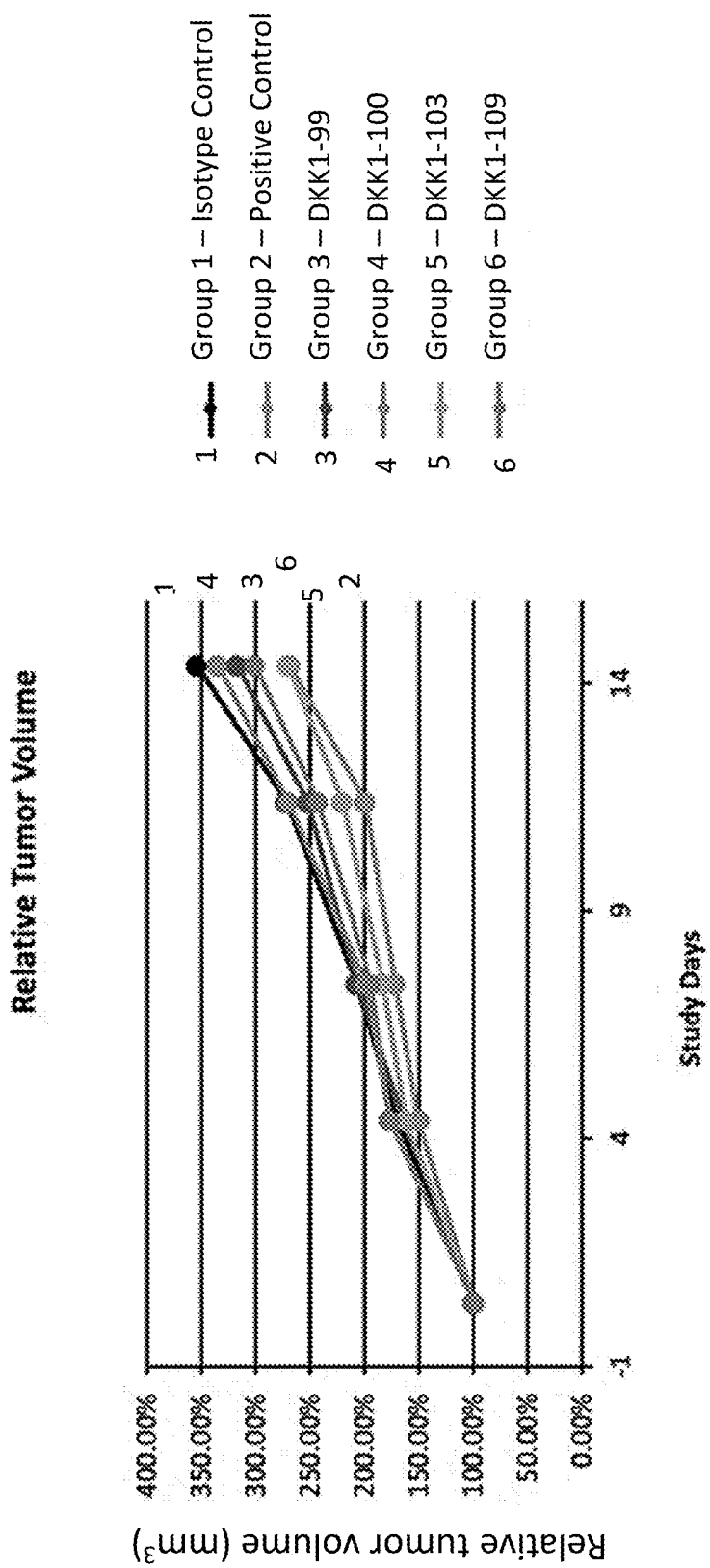
Figure 20C:
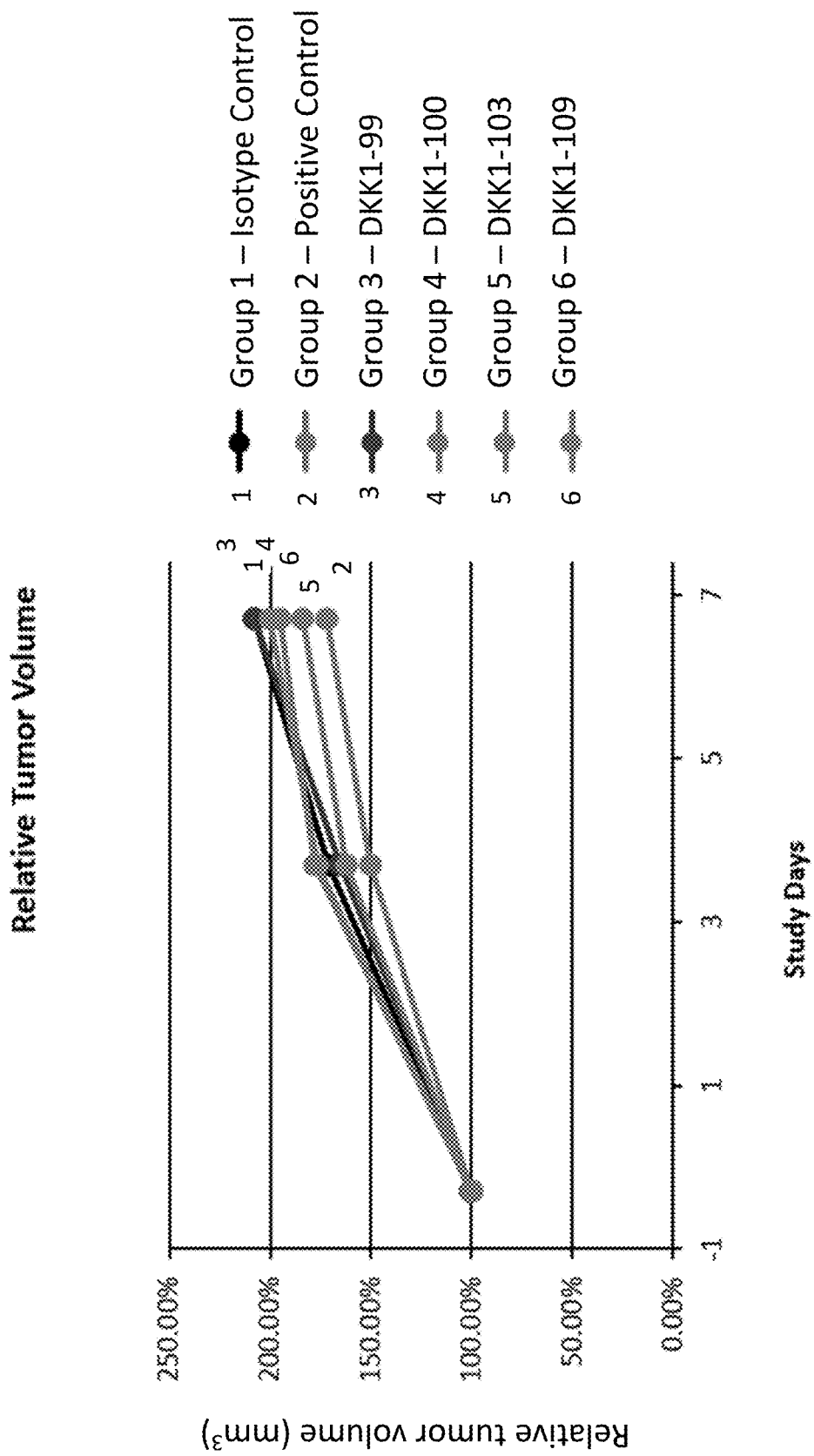
Figure 20D:
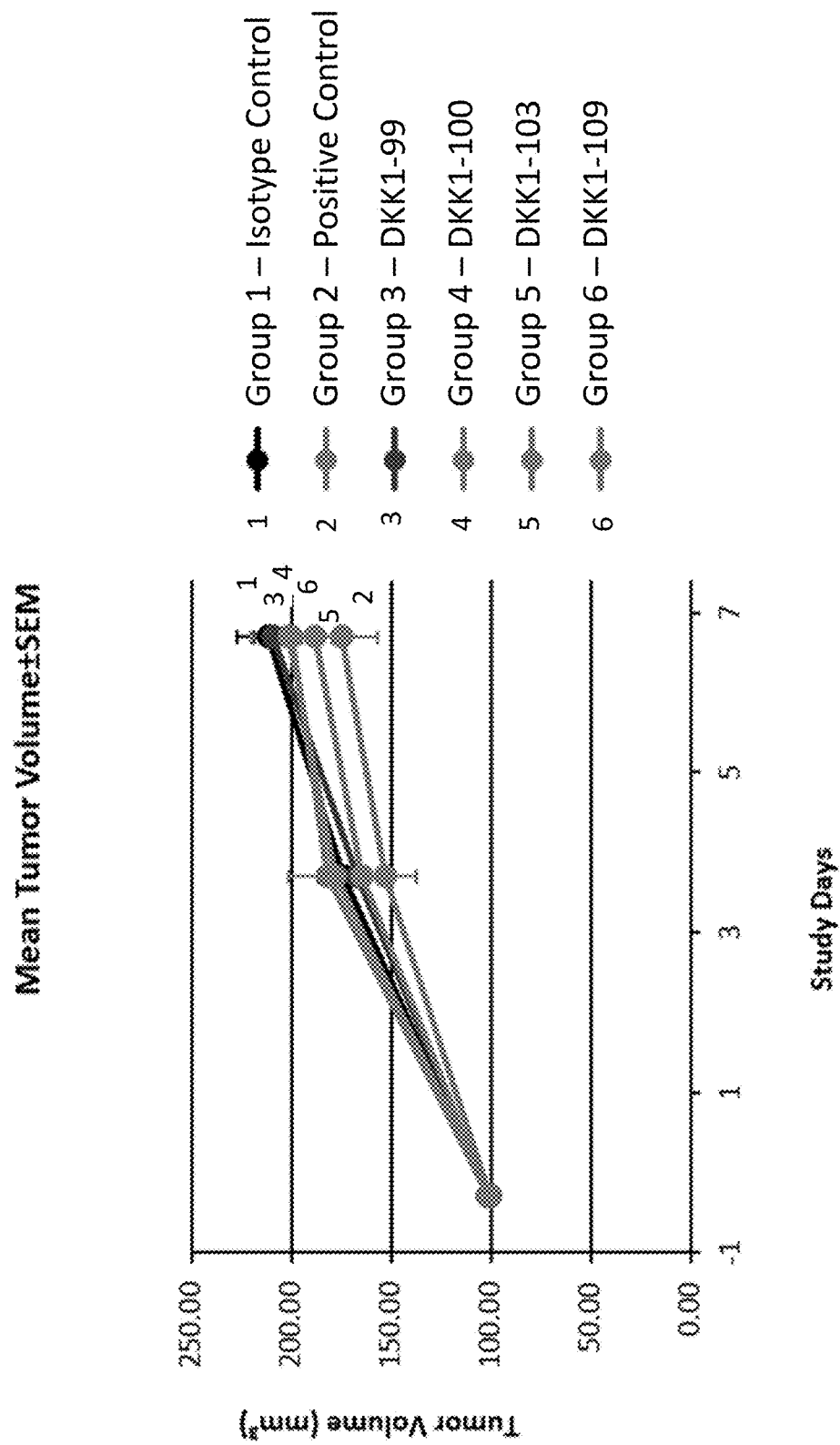

Preclinical studies in tumor regression are described in FIG. 20A, using a mouse model. Results of in vivo efficacy in PC3 tumor regression in SCID mice is shown in FIG. 20B-20D.

Figure 30:
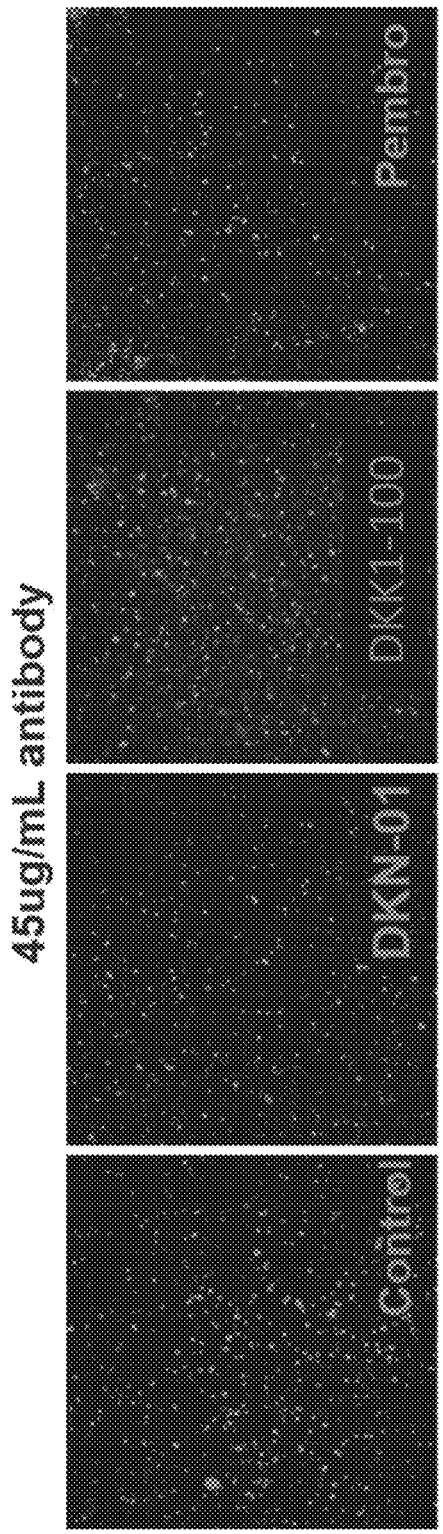
FIG. 30 depicts lung tumor organoid killing by immune cells with DKK1 inhibition.

Lung tumor organoid killing by immune cells with DKK1 inhibition is shown in FIG. 30.

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the disclosure. It is intended that the following claims define the scope of the disclosure and that methods and structures within the scope of these claims and their equivalents be covered thereby.

SEQUENCE LISTING (2727 sequences)

SEQ ID NO: 1 - protein, 9 aa, synthetic construct
GRTFSRFAM

SEQ ID NO: 2 - protein, 9 aa, synthetic construct
GSAFSSTVM

SEQ ID NO: 3 - protein, 9 aa, synthetic construct
GSTFSTYAM

SEQ ID NO: 4 - protein, 9 aa, synthetic construct
GNIFRINAM

SEQ ID NO: 5 - protein, 10 aa, synthetic construct
GGLTFSTYAM

SEQ ID NO: 6 - protein, 9 aa, synthetic construct
GIPFSTRTM

SEQ ID NO: 7 - protein, 12 aa, synthetic construct
GISGSVFSRTPM

SEQ ID NO: 8 - protein, 9 aa, synthetic construct
GFTFSNYAM

SEQ ID NO: 9 - protein, 9 aa, synthetic construct
GRSFSMYAM

SEQ ID NO: 10 - protein, 9 aa, synthetic construct
GRTISNYAM

SEQ ID NO: 11 - protein, 9 aa, synthetic construct
GPTVDAYAM

SEQ ID NO: 12 - protein, 9 aa, synthetic construct
GRTFNSRPM

SEQ ID NO: 13 - protein, 9 aa, synthetic construct
GFLMYDRAM

SEQ ID NO: 14 - protein, 9 aa, synthetic construct
GSIFSRLAM

SEQ ID NO: 15 - protein, 9 aa, synthetic construct
GFTFGTTTM

SEQ ID NO: 16 - protein, 9 aa, synthetic construct
GNIFTRNVM

SEQ ID NO: 17 - protein, 9 aa, synthetic construct
GGTFSRYAM

SEQ ID NO: 18 - protein, 9 aa, synthetic construct
GITFRFKAM

SEQ ID NO: 19 - protein, 6 aa, synthetic construct
GRTYGM

SEQ ID NO: 20 - protein, 9 aa, synthetic construct
GPTFSIYDM

SEQ ID NO: 21 - protein, 9 aa, synthetic construct
GIPSSIRAM

SEQ ID NO: 22 - protein, 9 aa, synthetic construct
GSTLSINAM

SEQ ID NO: 23 - protein, 9 aa, synthetic construct
GYNFSTFCM

SEQ ID NO: 24 - protein, 9 aa, synthetic construct
GSSFSAYGM

SEQ ID NO: 25 - protein, 9 aa, synthetic construct
GSTSRSYGM

SEQ ID NO: 26 - protein, 9 aa, synthetic construct
GFSLDYYGM

SEQ ID NO: 27 - protein, 9 aa, synthetic construct
GRTFSNYAM

SEQ ID NO: 28 - protein, 8 aa, synthetic construct
GLTTVYTM

SEQ ID NO: 29 - protein, 9 aa, synthetic construct
GSIGGLNAM

SEQ ID NO: 30 - protein, 9 aa, synthetic construct
GRTFSKYAM

SEQ ID NO: 31 - protein, 9 aa, synthetic construct
GRTLSRSAM

SEQ ID NO: 32 - protein, 9 aa, synthetic construct
GRTFSNGPM

SEQ ID NO: 33 - protein, 9 aa, synthetic construct
GRSLNTYTM

SEQ ID NO: 34 - protein, 9 aa, synthetic construct
GFTFDDRAM

SEQ ID NO: 35 - protein, 9 aa, synthetic construct
GRTFTTYPM

SEQ ID NO: 36 - protein, 9 aa, synthetic construct
GIPSTLRAM

SEQ ID NO: 37 - protein, 9 aa, synthetic construct
GRTFSSYSM

SEQ ID NO: 38 - protein, 9 aa, synthetic construct
GTSFSIGAM

SEQ ID NO: 39 - protein, 9 aa, synthetic construct
GTVFSISDM

SEQ ID NO: 40 - protein, 9 aa, synthetic construct
GRTISSFRM

SEQ ID NO: 41 - protein, 7 aa, synthetic construct
GRTLSRS

SEQ ID NO: 42 - protein, 7 aa, synthetic construct
GRTFSSL

SEQ ID NO: 43 - protein, 7 aa, synthetic construct
GTSFSVG

SEQ ID NO: 44 - skipped

SEQ ID NO: 45 - protein, 7 aa, synthetic construct
GRTFSNF

SEQ ID NO: 46 - protein, 7 aa, synthetic construct
GRTLSSI

SEQ ID NO: 47 - protein, 7 aa, synthetic construct
GRTFSSL

SEQ ID NO: 48 - protein, 7 aa, synthetic construct
GRSFGNF

SEQ ID NO: 49 - protein, 7 aa, synthetic construct
GFTFTNY

SEQ ID NO: 50 - protein, 7 aa, synthetic construct
GRTFSLY

SEQ ID NO: 51 - protein, 7 aa, synthetic construct
GRTFSTS

SEQ ID NO: 52 - protein, 7 aa, synthetic construct
GRTFSIS

SEQ ID NO: 53 - protein, 7 aa, synthetic construct
GRTFSSY

SEQ ID NO: 54 - protein, 7 aa, synthetic construct
GFTFDDR

SEQ ID NO: 55 - protein, 7 aa, synthetic construct
GFTFGDY

SEQ ID NO: 56 - protein, 7 aa, synthetic construct
GRTFSSL

SEQ ID NO: 57 - protein, 7 aa, synthetic construct
GSTFSKA

SEQ ID NO: 58 - protein, 7 aa, synthetic construct
GRRFSAD

SEQ ID NO: 59 - protein, 7 aa, synthetic construct
GFTVSNY

SEQ ID NO: 60 - protein, 7 aa, synthetic construct
GRAFSSS

SEQ ID NO: 61 - protein, 7 aa, synthetic construct
GRTFSSN

SEQ ID NO: 62 - protein, 7 aa, synthetic construct
GRTFSYN

SEQ ID NO: 63 - protein, 7 aa, synthetic construct
GFRMYDR

SEQ ID NO: 64 - protein, 7 aa, synthetic construct
GRTSSAY

SEQ ID NO: 65 - protein, 7 aa, synthetic construct
GRTFSRF

SEQ ID NO: 66 - protein, 7 aa, synthetic construct
GRTFSSY

SEQ ID NO: 67 - protein, 7 aa, synthetic construct
GRTFRSY

SEQ ID NO: 68 - protein, 7 aa, synthetic construct
GRTFSNY

SEQ ID NO: 69 - protein, 7 aa, synthetic construct
GRTFSSY

SEQ ID NO: 70 - protein, 7 aa, synthetic construct
GTSFSIG

SEQ ID NO: 71 - protein, 7 aa, synthetic construct
GRTISNA

SEQ ID NO: 72 - protein, 7 aa, synthetic construct
GGIYRVN

SEQ ID NO: 73 - protein, 7 aa, synthetic construct
GRTFSSK

SEQ ID NO: 74 - protein, 7 aa, synthetic construct
GIPFSSR

SEQ ID NO: 75 - protein, 7 aa, synthetic construct
GPTVDAY

SEQ ID NO: 76 - protein, 7 aa, synthetic construct
GIPFSTR

SEQ ID NO: 77 - protein, 7 aa, synthetic construct
GRTFNSR

SEQ ID NO: 78 - protein, 7 aa, synthetic construct
GFTFSSS

SEQ ID NO: 79 - protein, 9 aa, synthetic construct
SIGIAFSSR

SEQ ID NO: 80 - protein, 7 aa, synthetic construct
GFLMYDR

SEQ ID NO: 81 - protein, 7 aa, synthetic construct
GIAFQGY

SEQ ID NO: 82 - protein, 7 aa, synthetic construct
GRTFSNT

SEQ ID NO: 83 - protein, 7 aa, synthetic construct
GSTSSLR

SEQ ID NO: 84 - protein, 7 aa, synthetic construct
GRTFTNY

SEQ ID NO: 85 - protein, 7 aa, synthetic construct
GITFKRY

SEQ ID NO: 86 - protein, 7 aa, synthetic construct
GRTFINY

SEQ ID NO: 87 - protein, 7 aa, synthetic construct
GRTFSGY

SEQ ID NO: 88 - protein, 7 aa, synthetic construct
GLTFSTY

SEQ ID NO: 89 - protein, 7 aa, synthetic construct
GFTSDDY

SEQ ID NO: 90 - protein, 7 aa, synthetic construct
GRTFRSY

SEQ ID NO: 91 - protein, 7 aa, synthetic construct
GFTVSSY

SEQ ID NO: 92 - protein, 7 aa, synthetic construct
GFGFGSY

SEQ ID NO: 93 - protein, 7 aa, synthetic construct
GRTFSRY

SEQ ID NO: 94 - protein, 7 aa, synthetic construct
GRIFGGY

SEQ ID NO: 95 - protein, 7 aa, synthetic construct
GSIENIN

SEQ ID NO: 96 - protein, 10 aa, synthetic construct
GFTFSSFGNF

SEQ ID NO: 97 - protein, 7 aa, synthetic construct
GNIDRLY

SEQ ID NO: 98 - protein, 7 aa, synthetic construct
GRTFSNF

SEQ ID NO: 99 - protein, 14 aa, synthetic construct
EGVASITSGGTTNY

SEQ ID NO: 100 - protein, 14 aa, synthetic construct
EFVATINSLGGTSY

SEQ ID NO: 101 - protein, 15 aa, synthetic construct
EFVASINWGGGNTYY

SEQ ID NO: 102 - protein, 15 aa, synthetic construct
ELVAAISRSGGSTNY

SEQ ID NO: 103 - protein, 15 aa, synthetic construct
EFVAAVSWSGGNTYY

SEQ ID NO: 104 - protein, 14 aa, synthetic construct
EFVAAISSGATTLY

SEQ ID NO: 105 - protein, 15 aa, synthetic construct
EFVAALSKDGARTYY

SEQ ID NO: 106 - protein, 15 aa, synthetic construct
EFVAAISWSDGSTYY

SEQ ID NO: 107 - protein, 15 aa, synthetic construct
ELVAAISWSGGSTVY

SEQ ID NO: 108 - protein, 15 aa, synthetic construct
EFVAAISWRGGSTYY

SEQ ID NO: 109 - protein, 15 aa, synthetic construct
EFVSAISWSGSATFY

SEQ ID NO: 110 - protein, 15 aa, synthetic construct
EFVAAISSSASSTYY

SEQ ID NO: 111 - protein, 15 aa, synthetic construct
EIVAAISRTGSSIYY

SEQ ID NO: 112 - protein, 15 aa, synthetic construct
EFVAAISSSGISTIY

SEQ ID NO: 113 - protein, 15 aa, synthetic construct
ELVAAITSGGGTTYY

SEQ ID NO: 114 - protein, 15 aa, synthetic construct
EFVGAINWSGGNTVY

SEQ ID NO: 115 - protein, 15 aa, synthetic construct
EFVAGISWTLGRTYY

SEQ ID NO: 116 - protein, 15 aa, synthetic construct
EFVAAINRSGRSTRY

SEQ ID NO: 117 - protein, 15 aa, synthetic construct
EFVAGISWTLGRTYY

SEQ ID NO: 118 - protein, 13 aa, synthetic construct
EFVTGSNTGGTTY

SEQ ID NO: 119 - protein, 15 aa, synthetic construct
EWVSGISISDSSTYY

SEQ ID NO: 120 - protein, 14 aa, synthetic construct
ELVAAISWSGGTAY

SEQ ID NO: 121 - protein, 14 aa, synthetic construct
EWVAAISGGGSTMY

SEQ ID NO: 122 - protein, 15 aa, synthetic construct
EFVAGISWTLGRTYY

SEQ ID NO: 123 - protein, 15 aa, synthetic construct
EFVAGISWTLGRTYY

SEQ ID NO: 124 - protein, 14 aa, synthetic construct
EVVASIRWNAKPYY

SEQ ID NO: 125 - protein, 15 aa, synthetic construct
EWVASISTSGKTTYY

SEQ ID NO: 126 - protein, 15 aa, synthetic construct
EFVAAISWYVSTTFY

SEQ ID NO: 127 - protein, 15 aa, synthetic construct
EFVAAINYSGRSTVY

SEQ ID NO: 128 - protein, 15 aa, synthetic construct
EFVAAISWSGESTYY

SEQ ID NO: 129 - protein, 15 aa, synthetic construct
ELVAAISWSGGSTYY

SEQ ID NO: 130 - protein, 15 aa, synthetic construct
EFVAAISRGGKISHY

SEQ ID NO: 131 - protein, 14 aa, synthetic construct
ELVAVIISGGSTAY

SEQ ID NO: 132 - protein, 15 aa, synthetic construct
EFVAAISWSGGSTYY

SEQ ID NO: 133 - protein, 15 aa, synthetic construct
EFVAAISSSGSSTVY

SEQ ID NO: 134 - protein, 15 aa, synthetic construct
EFVAAINWSGASTVY

SEQ ID NO: 135 - protein, 15 aa, synthetic construct
EFIAAINLSSGSTYY

SEQ ID NO: 136 - protein, 15 aa, synthetic construct
EWVSSISPGGLFPYY

SEQ ID NO: 137 - protein, 15 aa, synthetic construct
EWVSAISPGGGYTVY

SEQ ID NO: 138 - protein, 15 aa, synthetic construct
EFVAAISRGGNVTPY

SEQ ID NO: 139 - protein, 6 aa, synthetic construct
SWSGGS

SEQ ID NO: 140 - protein, 5 aa, synthetic construct
TSGGR

SEQ ID NO: 141 - protein, 6 aa, synthetic construct
SWSGGT

SEQ ID NO: 142 - protein, 6 aa, synthetic construct
NRSGKS

SEQ ID NO: 143 - protein, 5 aa, synthetic construct
SATGS

SEQ ID NO: 144 - protein, 5 aa, synthetic construct
TRAGS

SEQ ID NO: 145 - protein, 5 aa, synthetic construct
SSGGS

SEQ ID NO: 146 - protein, 5 aa, synthetic construct
TSGGS

SEQ ID NO: 147 - protein, 6 aa, synthetic construct
NWSGRR

SEQ ID NO: 148 - protein, 6 aa, synthetic construct
NRSGKS

SEQ ID NO: 149 - protein, 6 aa, synthetic construct
NRSGKT

SEQ ID NO: 150 - protein, 5 aa, synthetic construct
SPSGN

SEQ ID NO: 151 - protein, 5 aa, synthetic construct
SRSGT

SEQ ID NO: 152 - protein, 5 aa, synthetic construct
STGGT

SEQ ID NO: 153 - protein, 6 aa, synthetic construct
DWSGRR

SEQ ID NO: 154 - protein, 6 aa, synthetic construct
SSSGGT

SEQ ID NO: 155 - protein, 6 aa, synthetic construct
TFSGAR

SEQ ID NO: 156 - protein, 5 aa, synthetic construct
RSGGT

SEQ ID NO: 157 - protein, 6 aa, synthetic construct
SWSGGS

SEQ ID NO: 158 - protein, 6 aa, synthetic construct
NRGGKI

SEQ ID NO: 159 - protein, 6 aa, synthetic construct
SRSGGS

SEQ ID NO: 160 - protein, 6 aa, synthetic construct
NRSGKS

SEQ ID NO: 161 - protein, 6 aa, synthetic construct
SRSGGR

SEQ ID NO: 162 - protein, 6 aa, synthetic construct
SRSGAS

SEQ ID NO: 163 - protein, 5 aa, synthetic construct
SARGM

SEQ ID NO: 164 - protein, 6 aa, synthetic construct
NLSSGS

SEQ ID NO: 165 - protein, 6 aa, synthetic construct
SMSGKE

SEQ ID NO: 166 - protein, 6 aa, synthetic construct
STSGKT

SEQ ID NO: 167 - protein, 6 aa, synthetic construct
SRSGGS

SEQ ID NO: 168 - protein, 6 aa, synthetic construct
SRSGAS

SEQ ID NO: 169 - protein, 5 aa, synthetic construct
RSGGT

SEQ ID NO: 170 - protein, 6 aa, synthetic construct
NWSGGS

SEQ ID NO: 171 - protein, 6 aa, synthetic construct
NWSGGL

SEQ ID NO: 172 - protein, 6 aa, synthetic construct
SRSGTG

SEQ ID NO: 173 - protein, 6 aa, synthetic construct
SWSGSA

SEQ ID NO: 174 - protein, 5 aa, synthetic construct
SSGAT

SEQ ID NO: 175 - protein, 6 aa, synthetic construct
SSSASS

SEQ ID NO: 176 - protein, 5 aa, synthetic construct
LRGGS

SEQ ID NO: 177 - protein, 6 aa, synthetic construct
TRSGGK

SEQ ID NO: 178 - protein, 6 aa, synthetic construct
SRTGSS

SEQ ID NO: 179 - protein, 6 aa, synthetic construct
DTNGGH

SEQ ID NO: 180 - protein, 5 aa, synthetic construct
TSGGS

SEQ ID NO: 181 - protein, 6 aa, synthetic construct
SWSLSR

SEQ ID NO: 182 - protein, 6 aa, synthetic construct
NRGGST

SEQ ID NO: 183 - protein, 7 aa, synthetic construct
TSRDGTT

SEQ ID NO: 184 - protein, 6 aa, synthetic construct
IWTGVS

SEQ ID NO: 185 - protein, 6 aa, synthetic construct
SWSGGS

SEQ ID NO: 186 - protein, 5 aa, synthetic construct
ASNGN

SEQ ID NO: 187 - protein, 6 aa, synthetic construct
SWSGGR

SEQ ID NO: 188 - protein, 6 aa, synthetic construct
SWSPGR

SEQ ID NO: 189 - protein, 6 aa, synthetic construct
SWSGGR

SEQ ID NO: 190 - protein, 6 aa, synthetic construct
SWTGGS

SEQ ID NO: 191 - protein, 6 aa, synthetic construct
SWSGGS

SEQ ID NO: 192 - protein, 6 aa, synthetic construct
SWSGAS

SEQ ID NO: 193 - protein, 6 aa, synthetic construct
SSGGGI

SEQ ID NO: 194 - protein, 6 aa, synthetic construct
NWSSRS

SEQ ID NO: 195 - protein, 6 aa, synthetic construct
SWSVSS

SEQ ID NO: 196 - protein, 5 aa, synthetic construct
LRGGS

SEQ ID NO: 197 - protein, 10 aa, synthetic construct
AADDGARGSW

SEQ ID NO: 198 - protein, 17 aa, synthetic construct
AAAYSGHFSGRVSDFLW

SEQ ID NO: 199 - protein, 10 aa, synthetic construct
AAKKVSFGDW

SEQ ID NO: 200 - protein, 8 aa, synthetic construct
AKDKNGPW

SEQ ID NO: 201 - protein, 18 aa, synthetic construct
AAEIGYYSGGTYYSSEAW

SEQ ID NO: 202 - protein, 18 aa, synthetic construct
AAGNGGRAYGYSRARYEW

SEQ ID NO: 203 - protein, 13 aa, synthetic construct
ARDLVGTDAFDIW

SEQ ID NO: 204 - protein, 18 aa, synthetic construct
AAEGGYSGTYYYTGDFDW

SEQ ID NO: 205 - protein, 18 aa, synthetic construct
AAEGGYSGTYYYTGDFDW

SEQ ID NO: 206 - protein, 22 aa, synthetic construct
AAAPRPKYVSVSYFSTSSNYDW

SEQ ID NO: 207 - protein, 22 aa, synthetic construct
AAAPRPKRVSVRYFSTSSNYDW

SEQ ID NO: 208 - protein, 18 aa, synthetic construct
AAGNGGRLYGHSRARYDW

SEQ ID NO: 209 - protein, 18 aa, synthetic construct
AAGNGGRKYGHHRARYDW

SEQ ID NO: 210 - protein, 15 aa, synthetic construct
ARGQRGRWLEPLTGW

SEQ ID NO: 211 - protein, 18 aa, synthetic construct
AKDLAAAGYYYYYGMDVW

SEQ ID NO: 212 - protein, 13 aa, synthetic construct
ARHDHNNRGLDYW

SEQ ID NO: 213 - protein, 8 aa, synthetic construct
ARDPFGKW

SEQ ID NO: 214 - protein, 18 aa, synthetic construct
AAESHGSTSPRNPLQYDW

SEQ ID NO: 215 - protein, 10 aa, synthetic construct
ASDESDAANW

SEQ ID NO: 216 - protein, 10 aa, synthetic construct
ATCTDFEYDW

SEQ ID NO: 217 - protein, 11 aa, synthetic construct
AAGKRYGYYDW

SEQ ID NO: 218 - protein, 18 aa, synthetic construct
AAQSRYRSNYYDHDKYAW

SEQ ID NO: 219 - protein, 16 aa, synthetic construct
AASKWYGGFGDTDIEW

SEQ ID NO: 220 - protein, 17 aa, synthetic construct
AADGVPEYSDYASGPVW

SEQ ID NO: 221 - protein, 8 aa, synthetic construct
ARDPSGKW

SEQ ID NO: 222 - protein, 11 aa, synthetic construct
AAGKRYGYYDW

SEQ ID NO: 223 - protein, 18 aa, synthetic construct
AAGNGGRNYGHSRARYEW

SEQ ID NO: 224 - protein, 18 aa, synthetic construct
AAEGGYSGTYYYTGDFDW

SEQ ID NO: 225 - protein, 17 aa, synthetic construct
AAGAGRDRGFSRAQYAW

SEQ ID NO: 226 - protein, 22 aa, synthetic construct
AAAPRPKRVSVSYFYTSSNYDW

SEQ ID NO: 227 - protein, 18 aa, synthetic construct
AAGNGGRTYGHSRARYEW

SEQ ID NO: 228 - protein, 18 aa, synthetic construct
AAGNGGRYYGHSRARYDW

SEQ ID NO: 229 - protein, 18 aa, synthetic construct
AAGNGGRSYGHSRARYDW

SEQ ID NO: 230 - protein, 22 aa, synthetic construct
AAAPRPKRVSVSYFYTSSNYDW

SEQ ID NO: 231 - protein, 18 aa, synthetic construct
AAGNGGRQYGHSRARYDW

SEQ ID NO: 232 - protein, 18 aa, synthetic construct
AAGNGGRQYGHSRARYDW

SEQ ID NO: 233 - protein, 18 aa, synthetic construct
AAGNGGRNYGHSRARYEW

SEQ ID NO: 234 - protein, 17 aa, synthetic construct
AARDAIVGVTDTSGYRW

SEQ ID NO: 235 - protein, 21 aa, synthetic construct
ARSSWFDCGVQGRDLGNEYDW

SEQ ID NO: 236 - protein, 19 aa, synthetic construct
AANSDSGFDSYSVWAAYEW

SEQ ID NO: 237 - protein, 15 aa, synthetic construct
GNGGRTYGHSRARYE

SEQ ID NO: 238 - protein, 15 aa, synthetic construct
GNGGRTYGHSRARYE

SEQ ID NO: 239 - protein, 15 aa, synthetic construct
GNGGRQYGHSRARYD

SEQ ID NO: 240 - protein, 15 aa, synthetic construct
GNGGRSYGHSRARYD

SEQ ID NO: 241 - protein, 15 aa, synthetic construct
GNGGRQYGHSRARYD

SEQ ID NO: 242 - protein, 15 aa, synthetic construct
GNGGRYYGHSRARYD

SEQ ID NO: 243 - protein, 15 aa, synthetic construct
GNGGRTYGHSRARYD

SEQ ID NO: 244 - protein, 15 aa, synthetic construct
GNGGRSYGHSRARYD

SEQ ID NO: 245 - protein, 19 aa, synthetic construct
APRPKRVSVQYFSTSSNYD

SEQ ID NO: 246 - protein, 15 aa, synthetic construct
GNGGRQYGHSRARYD

SEQ ID NO: 247 - protein, 15 aa, synthetic construct
GNGGRAYGYSRARYE

SEQ ID NO: 248 - protein, 15 aa, synthetic construct
GNGGRAYGYSRARYE

SEQ ID NO: 249 - protein, 15 aa, synthetic construct
GNGGRTYGHSRARYE

SEQ ID NO: 250 - protein, 15 aa, synthetic construct
GNGGRTYGHSRARYE

SEQ ID NO: 251 - protein, 19 aa, synthetic construct
APRPKRVSVSYFSTASNYD

SEQ ID NO: 252 - protein, 15 aa, synthetic construct
GNGGRLYGHSRARYD

SEQ ID NO: 253 - protein, 15 aa, synthetic construct
GNGGRTYGHSRARYD

SEQ ID NO: 254 - protein, 15 aa, synthetic construct
GNGGRQYGHSRARYD

SEQ ID NO: 255 - protein, 19 aa, synthetic construct
APRPKRVSVRYFSTSSNYD

SEQ ID NO: 256 - protein, 15 aa, synthetic construct
GNGGRLYGHSRARYD

SEQ ID NO: 257 - protein, 15 aa, synthetic construct
GNGGRTYGHSRARYD

SEQ ID NO: 258 - protein, 15 aa, synthetic construct
GNGGRHYGHSRARYD

SEQ ID NO: 259 - protein, 15 aa, synthetic construct
GNGGRLYGHSRARYD

SEQ ID NO: 260 - protein, 15 aa, synthetic construct
GNGGRSYGHSRARYD

SEQ ID NO: 261 - protein, 15 aa, synthetic construct
GNGGRTYGHSRARYE

SEQ ID NO: 262 - protein, 15 aa, synthetic construct
GNGGRNYGHSRARYE

SEQ ID NO: 263 - protein, 15 aa, synthetic construct
GNGGRTYGHSRARYE

SEQ ID NO: 264 - protein, 15 aa, synthetic construct
GNGGRNYGHSRARYE

SEQ ID NO: 265 - protein, 15 aa, synthetic construct
GNGGRHYGHSRARYD

SEQ ID NO: 266 - protein, 15 aa, synthetic construct
GNGGRTYGHSRARYD

SEQ ID NO: 267 - protein, 15 aa, synthetic construct
GNGGRQYGHSRARYD

SEQ ID NO: 268 - protein, 15 aa, synthetic construct
GNGGRKYGHHRARYD

SEQ ID NO: 269 - protein, 15 aa, synthetic construct
GNGGRAYGYSRARYE

SEQ ID NO: 270 - protein, 15 aa, synthetic construct
GNGGRTYGHSRARYD

SEQ ID NO: 271 - protein, 19 aa, synthetic construct
APRPKRVSVRYFSTSSNYD

SEQ ID NO: 272 - protein, 15 aa, synthetic construct
GNGGRAYGYSRARYE

SEQ ID NO: 273 - protein, 15 aa, synthetic construct
GNGGRLYGHSRARYD

SEQ ID NO: 274 - protein, 15 aa, synthetic construct
GNGGRHYGHSRARYD

SEQ ID NO: 275 - protein, 15 aa, synthetic construct
GNGGRTYGHSRARYE

SEQ ID NO: 276 - protein, 15 aa, synthetic construct
GNGGRKYGHHRARYD

SEQ ID NO: 277 - protein, 15 aa, synthetic construct
EGGYRGTYYYTGDFD

SEQ ID NO: 278 - protein, 15 aa, synthetic construct
GNGGRHYGHNRPRYD

SEQ ID NO: 279 - protein, 19 aa, synthetic construct
APRPKRVSVSYFSTASNYD

SEQ ID NO: 280 - protein, 15 aa, synthetic construct
GNRRRPYGYSHSRYD

SEQ ID NO: 281 - protein, 15 aa, synthetic construct
GNGGRNYGHSRSRYE

SEQ ID NO: 282 - protein, 19 aa, synthetic construct
APRPNRVSVRYFSTNNNYD

SEQ ID NO: 283 - protein, 15 aa, synthetic construct
GNGGRHYGHSRARYD

SEQ ID NO: 284 - protein, 15 aa, synthetic construct
GNGGRAYGYSRARYE

SEQ ID NO: 285 - protein, 19 aa, synthetic construct
APRPKRVSVRYFSTSSNYD

SEQ ID NO: 286 - protein, 19 aa, synthetic construct
APRPKRISVQYFTTSSNYD

SEQ ID NO: 287 - protein, 19 aa, synthetic construct
APRPKRVSFSYFSTSSNYE

SEQ ID NO: 288 - protein, 19 aa, synthetic construct
APRPKRVSVRYFNTSSNYD

SEQ ID NO: 289 - protein, 15 aa, synthetic construct
GNGGRYYNHSRTRYE

SEQ ID NO: 290 - protein, 15 aa, synthetic construct
GNGGSRYGHSRARYD

SEQ ID NO: 291 - protein, 15 aa, synthetic construct
GNGGRKYGHHRARYD

SEQ ID NO: 292 - protein, 15 aa, synthetic construct
GNGGRQYGHSRARYD

SEQ ID NO: 293 - protein, 15 aa, synthetic construct
EGGYSGTYYYTGDFD

SEQ ID NO: 294 - protein, 19 aa, synthetic construct
APRPKRVSVSYFSTASNYD

SEQ ID NO: 295 - protein, 115 aa, synthetic construct
EVQLVESGGGLVQPGGSLRLSCAASGRTFSRFAMGWFRQAPGKEREGVASITSGGTTNYADSVKGRFTISADNSKNTAYLQMNSLKPEDTAVYYCAADDGARGSWGQGTLVTVSS

SEQ ID NO: 296 - protein, 122 aa, synthetic construct
EVQLVESGGGLVQPGGSLRLSCAASGSAFSSTVMGWFRQAPGKEREFVATINSLGGTSYADSVKGRFTISADNSKNTAYLQMNSLKPEDTAVYYCAAAYSGHFSGRVSDFLWGQGTLVTVSS

SEQ ID NO: 297 - protein, 116 aa, synthetic construct
EVQLVESGGGLVQPGGSLRLSCAASGSTFSTYAMGWFRQAPGKEREFVASINWGGGNTYYADSVKGRFTISADNSKNTAYLQMNSLKPEDTAVYYCAAKKVSFGDWGQGTLVTVSS

SEQ ID NO: 298 - protein, 114 aa, synthetic construct
EVQLVESGGGLVQPGGSLRLSCAASGNIFRINAMGWFRQAPGKERELVAAISRSGGSTNYADSVKGRFTISADNSKNTAYLQMNSLKPEDTAVYYCAKDKNGPWGQGTLVTVSS

SEQ ID NO: 299 - protein, 125 aa, synthetic construct
EVQLVESGGGLVQPGGSLRLSCAASGGLTFSTYAMGWFRQAPGKEREFVAAVSWSGGNTYYADSVKGRFTISADNSKNTAYLQMNSLKPEDTAVYYCAAEIGYYSGGTYYSSEAWGQGTLVTVSS

SEQ ID NO: 300 - protein, 123 aa, synthetic construct
EVQLVESGGGLVQPGGSLRLSCAASGIPFSTRTMGWFRQAPGKEREFVAAISSGATTLYADSVKGRFTISADNSKNTAYLQMNSLKPEDTAVYYCAAGNGGRAYGYSRARYEWGQGTLVTVSS

SEQ ID NO: 301 - protein, 122 aa, synthetic construct
EVQLVESGGGLVQPGGSLRLSCAASGISGSVFSRTPMGWFRQAPGKEREFVAALSKDGARTYYADSVKGRFTISADNSKNTAYLQMNSLKPEDTAVYYCARDLVGTDAFDIWGQGTLVTVSS

SEQ ID NO: 302 - protein, 124 aa, synthetic construct
EVQLVESGGGLVQPGGSLRLSCAASGFTFSNYAMGWFRQAPGKEREFVAAISWSDGSTYYADSVKGRFTISADNSKNTAYLQMNSLKPEDTAVYYCAAEGGYSGTYYYTGDFDWGQGTLVTVSS

SEQ ID NO: 303 - protein, 124 aa, synthetic construct
EVQLVESGGGLVQPGGSLRLSCAASGRSFSMYAMGWFRQAPGKERELVAAISWSGGSTVYADSVKGRFTISADNSKNTAYLQMNSLKPEDTAVYYCAAEGGYSGTYYYTGDFDWGQGTLVTVSS

SEQ ID NO: 304 - protein, 128 aa, synthetic construct
EVQLVESGGGLVQPGGSLRLSCAASGRTISNYAMGWFRQAPGKEREFVAAISWRGGSTYYADSVKGRFTISADNSKNTAYLQMNSLKPEDTAVYYCAAAPRPKYVSVSYFSTSSNYDWGQGTLVTVSS

SEQ ID NO: 305 - protein, 128 aa, synthetic construct
EVQLVESGGGLVQPGGSLRLSCAASGPTVDAYAMGWFRQAPGKEREFVSAISWSGSATFYADSVKGRFTISADNSKNTAYLQMNSLKPEDTAVYYCAAAPRPKRVSVRYFSTSSNYDWGQGTLVTVSS

SEQ ID NO: 306 - protein, 124 aa, synthetic construct
EVQLVESGGGLVQPGGSLRLSCAASGRTFNSRPMGWFRQAPGKEREFVAAISSSASSTYYADSVKGRFTISADNSKNTAYLQMNSLKPEDTAVYYCAAGNGGRLYGHSRARYDWGQGTLVTVSS

SEQ ID NO: 307 - protein, 124 aa, synthetic construct
EVQLVESGGGLVQPGGSLRLSCAASGFLMYDRAMGWFRQAPGKEREIVAAISRTGSSIYYADSVKGRFTISADNSKNTAYLQMNSLKPEDTAVYYCAAGNGGRKYGHHRARYDWGQGTLVTVSS

SEQ ID NO: 308 - protein, 121 aa, synthetic construct
EVQLVESGGGLVQPGGSLRLSCAASGSIFSRLAMGWFRQAPGKEREFVAAISSSGISTIYADSVKGRFTISADNSKNTAYLQMNSLKPEDTAVYYCARGQRGRWLEPLTGWGQGTLVTVSS

SEQ ID NO: 309 - protein, 124 aa, synthetic construct
EVQLVESGGGLVQPGGSLRLSCAASGFTFGTTTMGWFRQAPGKERELVAAITSGGGTTYYADSVKGRFTISADNSKNTAYLQMNSLKPEDTAVYYCAKDLAAAGYYYYYGMDVWGQGTLVTVSS

SEQ ID NO: 310 - protein, 119 aa, synthetic construct
EVQLVESGGGLVQPGGSLRLSCAASGNIFTRNVMGWFRQAPGKEREFVGAINWSGGNTVYADSVKGRFTISADNSKNTAYLQMNSLKPEDTAVYYCARHDHNNRGLDYWGQGTLVTVSS

SEQ ID NO: 311 - protein, 114 aa, synthetic construct
EVQLVESGGGLVQPGGSLRLSCAASGGTFSRYAMGWFRQAPGKEREFVAGISWTLGRTYYADSVKGRFTISADNSKNTAYLQMNSLKPEDTAVYYCARDPFGKWGQGTLVTVSS

SEQ ID NO: 312 - protein, 124 aa, synthetic construct
EVQLVESGGGLVQPGGSLRLSCAASGITFRFKAMGWFRQAPGKEREFVAAINRSGRSTRYADSVKGRFTISADNSKNTAYLQMNSLKPEDTAVYYCAAESHGSTSPRNPLQYDWGQGTLVTVSS

SEQ ID NO: 313 - protein, 113 aa, synthetic construct
EVQLVESGGGLVQPGGSLRLSCAASGRTYGMGWFRQAPGKEREFVAGISWTLGRTYYADSVKGRFTISADNSKNTAYLQMNSLKPEDTAVYYCASDESDAANWGQGTLVTVSS

SEQ ID NO: 314 - protein, 114 aa, synthetic construct
EVQLVESGGGLVQPGGSLRLSCAASGPTFSIYDMGWFRQAPGKEREFVTGSNTGGTTYADSVKGRFTISADNSKNTAYLQMNSLKPEDTAVYYCATCTDFEYDWGQGTLVTVSS

SEQ ID NO: 315 - protein, 117 aa, synthetic construct
EVQLVESGGGLVQPGGSLRLSCAASGIPSSIRAMGWFRQAPGKEREWVSGISISDSSTYYADSVKGRFTISADNSKNTAYLQMNSLKPEDTAVYYCAAGKRYGYYDWGQGTLVTVSS

SEQ ID NO: 316 - protein, 123 aa, synthetic construct
EVQLVESGGGLVQPGGSLRLSCAASGSTLSINAMGWFRQAPGKERELVAAISWSGGTAYADSVKGRFTISADNSKNTAYLQMNSLKPEDTAVYYCAAQSRYRSNYYDHDKYAWGQGTLVTVSS

SEQ ID NO: 317 - protein, 121 aa, synthetic construct
EVQLVESGGGLVQPGGSLRLSCAASGYNFSTFCMGWFRQAPGKEREWVAAISGGGSTMYADSVKGRFTISADNSKNTAYLQMNSLKPEDTAVYYCAASKWYGGFGDTDIEWGQGTLVTVSS

SEQ ID NO: 318 - protein, 123 aa, synthetic construct
EVQLVESGGGLVQPGGSLRLSCAASGSSFSAYGMGWFRQAPGKEREFVAGISWTLGRTYYADSVKGRFTISADNSKNTAYLQMNSLKPEDTAVYYCAADGVPEYSDYASGPVWGQGTLVTVSS

SEQ ID NO: 319 - protein, 114 aa, synthetic construct
EVQLVESGGGLVQPGGSLRLSCAASGSTSRSYGMGWFRQAPGKEREFVAGISWTLGRTYYADSVKGRFTISADNSKNTAYLQMNSLKPEDTAVYYCARDPSGKWGQGTLVTVSS

SEQ ID NO: 320 - protein, 116 aa, synthetic construct
EVQLVESGGGLVQPGGSLRLSCAASGFSLDYYGMGWFRQAPGKEREVVASIRWNAKPYYADSVKGRFTISADNSKNTAYLQMNSLKPEDTAVYYCAAGKRYGYYDWGQGTLVTVSS

SEQ ID NO: 321 - protein, 124 aa, synthetic construct
EVQLVESGGGLVQPGGSLRLSCAASGRTFSNYAMGWFRQAPGKEREWVASISTSGKTTYYADSVKGRFTISADNSKNTAYLQMNSLKPEDTAVYYCAAGNGGRNYGHSRARYEWGQGTLVTVSS

SEQ ID NO: 322 - protein, 123 aa, synthetic construct
EVQLVESGGGLVQPGGSLRLSCAASGLTTVYTMGWFRQAPGKEREFVAAISWYVSTTFYADSVKGRFTISADNSKNTAYLQMNSLKPEDTAVYYCAAEGGYSGTYYYTGDFDWGQGTLVTVSS

SEQ ID NO: 323 - protein, 123 aa, synthetic construct
EVQLVESGGGLVQPGGSLRLSCAASGSIGGLNAMGWFRQAPGKEREFVAAINYSGRSTVYADSVKGRFTISADNSKNTAYLQMNSLKPEDTAVYYCAAGAGRDRGFSRAQYAWGQGTLVTVSS

SEQ ID NO: 324 - protein, 128 aa, synthetic construct
EVQLVESGGGLVQPGGSLRLSCAASGRTFSKYAMGWFRQAPGKEREFVAAISWSGESTYYADSVKGRFTISADNSKNTAYLQMNSLKPEDTAVYYCAAAPRPKRVSVSYFYTSSNYDWGQGTLVTVSS

SEQ ID NO: 325 - protein, 124 aa, synthetic construct
EVQLVESGGGLVQPGGSLRLSCAASGRTLSRSAMGWFRQAPGKERELVAAISWSGGSTYYADSVKGRFTISADNSKNTAYLQMNSLKPEDTAVYYCAAGNGGRTYGHSRARYEWGQGTLVTVSS

SEQ ID NO: 326 - protein, 124 aa, synthetic construct
EVQLVESGGGLVQPGGSLRLSCAASGRTFSNGPMGWFRQAPGKEREFVAAISRGGKISHYADSVKGRFTISADNSKNTAYLQMNSLKPEDTAVYYCAAGNGGRYYGHSRARYDWGQGTLVTVSS

SEQ ID NO: 327 - protein, 123 aa, synthetic construct
EVQLVESGGGLVQPGGSLRLSCAASGRSLNTYTMGWFRQAPGKERELVAVIISGGSTAYADSVKGRFTISADNSKNTAYLQMNSLKPEDTAVYYCAAGNGGRSYGHSRARYDWGQGTLVTVSS

SEQ ID NO: 328 - protein, 128 aa, synthetic construct
EVQLVESGGGLVQPGGSLRLSCAASGFTFDDRAMGWFRQAPGKEREFVAAISWSGGSTYYADSVKGRFTISADNSKNTAYLQMNSLKPEDTAVYYCAAAPRPKRVSVSYFYTSSNYDWGQGTLVTVSS

SEQ ID NO: 329 - protein, 124 aa, synthetic construct
EVQLVESGGGLVQPGGSLRLSCAASGRTFTTYPMGWFRQAPGKEREFVAAISSSGSSTVYADSVKGRFTISADNSKNTAYLQMNSLKPEDTAVYYCAAGNGGRQYGHSRARYDWGQGTLVTVSS

SEQ ID NO: 330 - protein, 124 aa, synthetic construct
EVQLVESGGGLVQPGGSLRLSCAASGIPSTLRAMGWFRQAPGKEREFVAAINWSGASTVYADSVKGRFTISADNSKNTAYLQMNSLKPEDTAVYYCAAGNGGRQYGHSRARYDWGQGTLVTVSS

SEQ ID NO: 331 - protein, 124 aa, synthetic construct
EVQLVESGGGLVQPGGSLRLSCAASGRTFSSYSMGWFRQAPGKEREFIAAINLSSGSTYYADSVKGRFTISADNSKNTAYLQMNSLKPEDTAVYYCAAGNGGRNYGHSRARYEWGQGTLVTVSS

SEQ ID NO: 332 - protein, 123 aa, synthetic construct
EVQLVESGGGLVQPGGSLRLSCAASGTSFSIGAMGWFRQAPGKEREWVSSISPGGLFPYYADSVKGRFTISADNSKNTAYLQMNSLKPEDTAVYYCAARDAIVGVTDTSGYRWGQGTLVTVSS

SEQ ID NO: 333 - protein, 127 aa, synthetic construct
EVQLVESGGGLVQPGGSLRLSCAASGTVFSISDMGWFRQAPGKEREWVSAISPGGGYTVYADSVKGRFTISADNSKNTAYLQMNSLKPEDTAVYYCARSSWFDCGVQGRDLGNEYDWGQGTLVTVSS

SEQ ID NO: 334 - protein, 125 aa, synthetic construct
EVQLVESGGGLVQPGGSLRLSCAASGRTISSFRMGWFRQAPGKEREFVAAISRGGNVTPYADSVKGRFTISADNSKNTAYLQMNSLKPEDTAVYYCAANSDSGFDSYSVWAAYEWGQGTLVTVSS

SEQ ID NO: 335 - protein, 124 aa, synthetic construct; identical to SEQ ID NO: 325

SEQ ID NO: 336 - protein, 122 aa, synthetic construct
EVQLVESGGGLVQPGGSLRLSCAASGRTFSSLPMGWFRQAPGKERELVAAITSGGRTYADSVKGRFTISADNSKNTAYLQMNSLKPEDTAVYYCAAGNGGRTYGHSRARYEWGQGTLVTVSS

SEQ ID NO: 337 - protein, 124 aa, synthetic construct
EVQLVESGGGLVQPGGSLRLSCAASGTSFSVGAMGWFRQAPGKEREFVGAVSWSGGTTVYADSVKGRFTISADNSKNTAYLQMNSLKPEDTAVYYCAAGNGGRQYGHSRARYDWGQGTLVTVSS

SEQ ID NO: 338 - protein, 120 aa, synthetic construct
EVQLVESGGGLVQPGGSLRLSCAASGRGAMGWFRQAPGKEREFVAAINRSGKSTYYADSVKGRFTISADNSKNTAYLQMNSLKPEDTAVYYCAAGNGGRSYGHSRARYDWGQGTLVTVSS

SEQ ID NO: 339 - protein, 123 aa, synthetic construct
EVQLVESGGGLVQPGGSLRLSCAASGRTFSNFAMGWFRQAPGKEREFVAAISATGSTYYADSVKGRFTISADNSKNTAYLQMNSLKPEDTAVYYCAAGNGGRQYGHSRARYDWGQGTLVTVSS

SEQ ID NO: 340 - protein, 123 aa, synthetic construct
EVQLVESGGGLVQPGGSLRLSCAASGRTLSSITMGWFRQAPGKERELVATITRAGSTNYADSVKGRFTISADNSKNTAYLQMNSLKPEDTAVYYCAAGNGGRYYGHSRARYDWGQGTLVTVSS

SEQ ID NO: 341 - protein, 123 aa, synthetic construct
EVQLVESGGGLVQPGGSLRLSCAASGRTFSSLPMGWFRQAPGKERELVASISSGGSTYYADSVKGRFTISADNSKNTAYLQMNSLKPEDTAVYYCAAGNGGRTYGHSRARYDWGQGTLVTVSS

SEQ ID NO: 342 - protein, 123 aa, synthetic construct
EVQLVESGGGLVQPGGSLRLSCAASGRSFGNFPMGWFRQAPGKERELVAAVTSGGSTYYADSVKGRFTISADNSKNTAYLQMNSLKPEDTAVYYCAAGNGGRSYGHSRARYDWGQGTLVTVSS

SEQ ID NO: 343 - protein, 128 aa, synthetic construct
EVQLVESGGGLVQPGGSLRLSCAASGFTFTNYAMGWFRQAPGKEREVVAVVNWSGRRTYYADSVKGRFTISADNSKNTAYLQMNSLKPEDTAVYYCAAAPRPKRVSVQYFSTSSNYDWGQGTLVTVSS

SEQ ID NO: 344 - protein, 124 aa, synthetic construct
EVQLVESGGGLVQPGGSLRLSCAASGRTFSLYTMGWFRQAPGKEREFVAAINRSGKSTYYADSVKGRFTISADNSKNTAYLQMNSLKPEDTAVYYCAAGNGGRQYGHSRARYDWGQGTLVTVSS

SEQ ID NO: 345 - protein, 124 aa, synthetic construct
EVQLVESGGGLVQPGGSLRLSCAASGRTFSTSAMGWFRQAPGKEREFVAVINRSGKTTYYADSVKGRFTISADNSKNTAYLQMNSLKPEDTAVYYCAAGNGGRAYGYSRARYEWGQGTLVTVSS

SEQ ID NO: 346 - protein, 123 aa, synthetic construct
EVQLVESGGGLVQPGGSLRLSCAASGRTFSISAMGWFRQAPGKEREFVAAISPSGNTYYADSVKGRFTISADNSKNTAYLQMNSLKPEDTAVYYCAAGNGGRAYGYSRARYEWGQGTLVTVSS

SEQ ID NO: 347 - protein, 123 aa, synthetic construct
EVQLVESGGGLVQPGGSLRLSCAASGRTFSSYPMGWFRQAPGKEREFVASISRSGTTYYADSVKGRFTISADNSKNTAYLQMNSLKPEDTAVYYCAAGNGGRTYGHSRARYEWGQGTLVTVSS

SEQ ID NO: 348 - protein, 123 aa, synthetic construct
EVQLVESGGGLVQPGGSLRLSCAASGFTFDDRAMGWFRQAPGKEREFVAAISTGGTTVYADSVKGRFTISADNSKNTAYLQMNSLKPEDTAVYYCAAGNGGRTYGHSRARYEWGQGTLVTVSS

SEQ ID NO: 349 - protein, 128 aa, synthetic construct
EVQLVESGGGLVQPGGSLRLSCAASGFTFGDYAMGWFRQAPGKEREFVGAIDWSGRRITYADSVKGRFTISADNSKNTAYLQMNSLKPEDTAVYYCAAAPRPKRVSVSYFSTASNYDWGQGTLVTVSS

SEQ ID NO: 350 - protein, 124 aa, synthetic construct
EVQLVESGGGLVQPGGSLRLSCAASGRTFSSLPMGWFRQAPGKERELVARISSSGGTTYYADSVKGRFTISADNSKNTAYLQMNSLKPEDTAVYYCAAGNGGRLYGHSRARYDWGQGTLVTVSS

SEQ ID NO: 351 - protein, 124 aa, synthetic construct
EVQLVESGGGLVQPGGSLRLSCAASGSTFSKAVMGWFRQAPGKEREFVATITFSGARTHYADSVKGRFTISADNSKNTAYLQMNSLKPEDTAVYYCAAGNGGRTYGHSRARYDWGQGTLVTVSS

SEQ ID NO: 352 - protein, 123 aa, synthetic construct
EVQLVESGGGLVQPGGSLRLSCAASGRRFSADVMGWFRQAPGKEREFVAAIRSGGTTLYADSVKGRFTISADNSKNTAYLQMNSLKPEDTAVYYCAAGNGGRQYGHSRARYDWGQGTLVTVSS

SEQ ID NO: 353 - protein, 128 aa, synthetic construct
EVQLVESGGGLVQPGGSLRLSCAASGFTVSNYAMGWFRQAPGKEREFVAAISWSGGSTYYADSVKGRFTISADNSKNTAYLQMNSLKPEDTAVYYCAAAPRPKRVSVRYFSTSSNYDWGQGTLVTVSS

SEQ ID NO: 354 - protein, 124 aa, synthetic construct
EVQLVESGGGLVQPGGSLRLSCAASGRAFSSSAMGWFRQAPGKEREFVAAINRGGKISHYADSVKGRFTISADNSKNTAYLQMNSLKPEDTAVYYCAAGNGGRLYGHSRARYDWGQGTLVTVSS

SEQ ID NO: 355 - protein, 124 aa, synthetic construct
EVQLVESGGGLVQPGGSLRLSCAASGRTFSSNVMGWFRQAPGKEREFVSAISRSGGSTVYADSVKGRFTISADNSKNTAYLQMNSLKPEDTAVYYCAAGNGGRTYGHSRARYDWGQGTLVTVSS

SEQ ID NO: 356 - protein, 124 aa, synthetic construct
EVQLVESGGGLVQPGGSLRLSCAASGRTFSYNPMGWFRQAPGKEREFVAAINRSGKSTYYADSVKGRFTISADNSKNTAYLQMNSLKPEDTAVYYCAAGNGGRHYGHSRARYDWGQGTLVTVSS

SEQ ID NO: 357 - protein, 124 aa, synthetic construct
EVQLVESGGGLVQPGGSLRLSCAASGFRMYDRVMGWFRQAPGKEREFVATISRSGGRTYYADSVKGRFTISADNSKNTAYLQMNSLKPEDTAVYYCAAGNGGRLYGHSRARYDWGQGTLVTVSS

SEQ ID NO: 358 - protein, 124 aa, synthetic construct
EVQLVESGGGLVQPGGSLRLSCAASGRTSSAYAMGWFRQAPGKEREFVAAISRSGASAYYADSVKGRFTISADNSKNTAYLQMNSLKPEDTAVYYCAAGNGGRSYGHSRARYDWGQGTLVTVSS

SEQ ID NO: 359 - protein, 123 aa, synthetic construct
EVQLVESGGGLVQPGGSLRLSCAASGRTFSRFAMGWFRQAPGKERELVAAISARGMPAYADSVKGRFTISADNSKNTAYLQMNSLKPEDTAVYYCAAGNGGRTYGHSRARYEWGQGTLVTVSS

SEQ ID NO: 360 - protein, 124 aa, synthetic construct; identical to SEQ ID NO: 331

SEQ ID NO: 361 - protein, 124 aa, synthetic construct
EVQLVESGGGLVQPGGSLRLSCAASGRTFRSYPMGWFRQAPGKEREFVAAISMSGKETWYADSVKGRFTISADNSKNTAYLQMNSLKPEDTAVYYCAAGNGGRTYGHSRARYEWGQGTLVTVSS

SEQ ID NO: 362 - protein, 124 aa, synthetic construct; identical to SEQ ID NO: 321

SEQ ID NO: 363 - protein, 124 aa, synthetic construct
EVQLVESGGGLVQPGGSLRLSCAASGRTFSSYPMGWFRQAPGKEREFVAAISRSGGSTVYADSVKGRFTISADNSKNTAYLQMNSLKPEDTAVYYCAAGNGGRHYGHSRARYDWGQGTLVTVSS

SEQ ID NO: 364 - protein, 124 aa, synthetic construct
EVQLVESGGGLVQPGGSLRLSCAASGTSFSIGAMGWFRQAPGKERELLAAISRSGASAYYADSVKGRFTISADNSKNTAYLQMNSLKPEDTAVYYCAAGNGGRTYGHSRARYDWGQGTLVTVSS

SEQ ID NO: 365 - protein, 123 aa, synthetic construct
EVQLVESGGGLVQPGGSLRLSCAASGRTISNAAMGWFRQAPGKERELVAVIRSGGTTLYADSVKGRFTISADNSKNTAYLQMNSLKPEDTAVYYCAAGNGGRQYGHSRARYDWGQGTLVTVSS

SEQ ID NO: 366 - protein, 124 aa, synthetic construct
EVQLVESGGGLVQPGGSLRLSCAASGGIYRVNTMGWFRQAPGKEREFVAAINWSGGSTIYADSVKGRFTISADNSKNTAYLQMNSLKPEDTAVYYCAAGNGGRKYGHHRARYDWGQGTLVTVSS

SEQ ID NO: 367 - protein, 124 aa, synthetic construct
EVQLVESGGGLVQPGGSLRLSCAASGRTFSSKTMGWFRQAPGKEREFVAAINWSGGLTVYADSVKGRFTISADNSKNTAYLQMNSLKPEDTAVYYCAAGNGGRAYGYSRARYEWGQGTLVTVSS

SEQ ID NO: 368 - protein, 124 aa, synthetic construct
EVQLVESGGGLVQPGGSLRLSCAASGIPFSSRTMGWFRQAPGKEREFVAAISRSGTGTYYADSVKGRFTISADNSKNTAYLQMNSLKPEDTAVYYCAAGNGGRTYGHSRARYDWGQGTLVTVSS

SEQ ID NO: 369 - protein, 128 aa, synthetic construct; identical to SEQ ID NO: 305

SEQ ID NO: 370 - protein, 123 aa, synthetic construct; identical to SEQ ID NO: 300

SEQ ID NO: 371 - protein, 124 aa, synthetic construct; identical to SEQ ID NO: 306

SEQ ID NO: 372 - protein, 123 aa, synthetic construct
EVQLVESGGGLVQPGGSLRLSCAASGFTFSSSPMGWFRQAPGKERELVAVILRGGSTNYADSVKGRFTISADNSKNTAYLQMNSLKPEDTAVYYCAAGNGGRHYGHSRARYDWGQGTLVTVSS

SEQ ID NO: 373 - protein, 126 aa, synthetic construct
EVQLVESGGGLVQPGGSLRLSCAASSIGIAFSSRTMGWFRQAPGKEREFVAAVTRSGGKSYYADSVKGRFTISADNSKNTAYLQMNSLKPEDTAVYYCAAGNGGRTYGHSRARYEWGQGTLVTVSS

SEQ ID NO: 374 - protein, 124 aa, synthetic construct; identical to SEQ ID NO: 307

SEQ ID NO: 375 - protein, 124 aa, synthetic construct
EVQLVESGGGLVQPGGSLRLSCAASGIAFQGYAMGWFRQAPGKERELVAAIDTNGGHTLYADSVKGRFTISADNSKNTAYLQMNSLKPEDTAVYYCAAEGGYRGTYYYTGDFDWGQGTLVTVSS

SEQ ID NO: 376 - protein, 123 aa, synthetic construct
EVQLVESGGGLVQPGGSLRLSCAASGRTFSNTLMGWFRQAPGKEREWVARITSGGSTHYADNVKGRFTIITDNSKNTAYLLMISLKPQNTAEYYWSAGNGGRHYGHNRPRYDWCHGGLVTVIT

SEQ ID NO: 377 - protein, 128 aa, synthetic construct
EVQLVESGGGLVQPGGSLRLSCAASGSTSSLRTMGWFRQAPGKEREFVAAISWSLSRTHYADSVKGRFTISADNSKNTAYLQMNSLKPEDTAVYYCAAAPRPKRVSVSYFSTASNYDWGQGTLVTVSS

SEQ ID NO: 378 - protein, 124 aa, synthetic construct
EVQLVESGGGLVQPGGSLRLSCAASGRTFTNYPMGWFRQAPGKEREFVAAINRGGSTTYYADSVKGRFTISADNSKNTAYLQMNSLKPEDTAVYYCAAGNRRRPYGYSHSRYDWGQGTLVTVSS

SEQ ID NO: 379 - protein, 125 aa, synthetic construct
EVQLVESGGGLVQPGGSLRLSCAASGITFKRYVMGWFRQAPGKEREFVATITSRDGTTYYYADSVKGRFTISADNSKNTAYLQMNSLKPEDTAVYYWAAGNGGRNYGHSRSRYEWGQGTLVTVSS

SEQ ID NO: 380 - protein, 128 aa, synthetic construct
EVQLVESGGGLVQPGGSLRLSCAASGRTFINYAMGWFRQAPGKEREFVAAIIWTGVSTYYADSVKGRFTIIADNSKNTAYLQMNSLKPEDTAVYYCAAAPRPNRVSVRYFSTNNNYDWGQGTLVTVSS

SEQ ID NO: 381 - protein, 124 aa, synthetic construct
EVQLVESGGGLVQPGGSLRLSCAASGRTFSGYTMGWFRQAPGKEREFVAAISWSGGSTYYADSVKGRFTISADNSKNTAYLQMNSLKPEDTAVYHCAAGNGGRHYGHSRARYDWGQGTLVTVSS

SEQ ID NO: 382 - protein, 123 aa, synthetic construct
EVQLVESGGGLVQPGGSLRLSCAASGLTFSTYPMGWFRQAPGKERELVALIASNGNTHYADSVKGRFTISADNSKNTAYLQMNSLKPEDTAVYYCAAGNGGRAYGYSRARYEWGQGTLVTVSS

SEQ ID NO: 383 - protein, 128 aa, synthetic construct
EVQLVESGGGLVQPGGSLRLSCAASGFTSDDYAMGWFRQAPGKEREFVAAISWSGGRTYYADSVKGRFTISADNSKNTAYLQMNSLKPEDTAVYYCAAAPRPKRVSVRYFSTSSNYDWGQGTLVTVSS

SEQ ID NO: 384 - protein, 128 aa, synthetic construct
EVQLVESGGGLVQPGGSLRLSCAASGRTFRSYAMGWFRQAPGKEREFVAAISWSPGRTHYADSVKGRFTISADNSKNTAYLQMNSLKPEDTAVYYCAAAPRPKRISVQYFTTSSNYDWGQGTLVTVSS

SEQ ID NO: 385 - protein, 128 aa, synthetic construct
EVQLVESGGGLVQPGGSLRLSCAASGFTVSSYTMGWFRQAPGKEREFVAAISWSGGRTYYADSVKGRFTISADNSKNTAYLQMNSLKPEDTAVYYCAAAPRPKRVSFSYFSTSSNYEWGQGTLVTVSS

SEQ ID NO: 386 - protein, 128 aa, synthetic construct
EVQLVESGGGLVQPGGSLRLSCAASGFGFGSYNMGWFRQAPGKEREFVAMISWTGGSTYYADSVKGRFTISADNSKNTAYLQMNSLKPEDTAVYYCAAAPRPKRVSVRYFNTSSNYDWGQGTLVTVSS

SEQ ID NO: 387 - protein, 124 aa, synthetic construct
EVQLVESGGGLVQPGGSLRLSCAASGRTFSRYPMGWFRQAPGKEREFVAAISWSGGSTVYADSVKGRFTISADNSKNTAYLQMNSLKPEDTAVYYCAAGNGGRYYNHSRTRYEWGQGTLVTVSS

SEQ ID NO: 388 - protein, 124 aa, synthetic construct
EVQLVESGGGLVQPGGSLRLSCAASGRIFGGYAMGWFRQAPGKEREFVAAISWSGASAIYADSVKGRFTISADNSKNTAYLQMNSLKPEDTAVYYCAAGNGGSRYGHSRARYDWGQGTLVTVSS

SEQ ID NO: 389 - protein, 124 aa, synthetic construct
EVQLVESGGGLVQPGGSLRLSCAASGSIENINAMGWFRQAPGKEREFVAAISSGGGITIYADSVKGRFTISADNSKNTAYLQMNSLKPEDTAVYYCAAGNGGRKYGHHRARYDWGQGTLVTVSS

SEQ ID NO: 390 - protein, 127 aa, synthetic construct
EVQLVESGGGLVQPGGSLRLSCAASGFTFSSFGNFPMGWFRQAPGKEREFVAAINWSSRSTVYADSVKGRFTISADNSKNTAYLQMNSLKPEDTAVYYCAAGNGGRQYGHSRARYDWGQGTLVTVSS

SEQ ID NO: 391 - protein, 124 aa, synthetic construct
EVQLVESGGGLVQPGGSLRLSCAASGNIDRLYAMGWFRQAPGKEREFVAAISWSVSSTYYADSVKGRFTISADNSKNTAYLQMNSLKPEDTAVYYCAAEGGYSGTYYYTGDFDWGQGTLVTVSS

SEQ ID NO: 392 - protein, 127 aa, synthetic construct
EVQLVESGGGLVQPGGSLRLSCAASGRTFSNFAMGWFRQAPGKEREFVAVILRGGSTNYADSVKGRFTISADNSKNTAYLQMNSLKPEDTAVYYCAAAPRPKRVSVSYFSTASNYDWGQGTLVTVSS

SEQ ID NO: 393 - DNA, 62 bp, synthetic construct
  source 1..62: mol_type = other DNA
  modified_base 51: mod_base = OTHER; note = Thymidine-succinyl hexamide cyanoethyl diisopropyl phosphoramidite
  modified_base 52: mod_base = OTHER; note = Thymidine-succinyl hexamide cyanoethyl diisopropyl phosphoramidite
agacaatcaaccatttggggtggacagccttgacctctagacttcggcattttttttttttt

SEQ ID NO: 394 - protein, 127 aa, synthetic construct; identical to SEQ ID NO: 392

SEQ ID NO: 395 - protein, 124 aa, synthetic construct; identical to SEQ ID NO: 391

SEQ ID NO: 396 - protein, 127 aa, synthetic construct; identical to SEQ ID NO: 390

SEQ ID NO: 397 - protein, 124 aa, synthetic construct; identical to SEQ ID NO: 389

SEQ ID NO: 398 - protein, 124 aa, synthetic construct; identical to SEQ ID NO: 388

SEQ ID NO: 399 - protein, 124 aa, synthetic construct; identical to SEQ ID NO: 387

SEQ ID NO: 400 - protein, 128 aa, synthetic construct; identical to SEQ ID NO: 386

SEQ ID NO: 401 - protein, 128 aa, synthetic construct; identical to SEQ ID NO: 385

SEQ ID NO: 402 - protein, 128 aa, synthetic construct; identical to SEQ ID NO: 384

SEQ ID NO: 403 - protein, 128 aa, synthetic construct; identical to SEQ ID NO: 383

SEQ ID NO: 404 - protein, 123 aa, synthetic construct; identical to SEQ ID NO: 382

SEQ ID NO: 405 - protein, 124 aa, synthetic construct; identical to SEQ ID NO: 381

SEQ ID NO: 406 - protein, 128 aa, synthetic construct; identical to SEQ ID NO: 380

SEQ ID NO: 407 - protein, 125 aa, synthetic construct; identical to SEQ ID NO: 379

SEQ ID NO: 408 - protein, 124 aa, synthetic construct; identical to SEQ ID NO: 378

SEQ ID NO: 409 - protein, 128 aa, synthetic construct; identical to SEQ ID NO: 377

SEQ ID NO: 410 - protein, 123 aa, synthetic construct; identical to SEQ ID NO: 376

SEQ ID NO: 411 - protein, 124 aa, synthetic construct; identical to SEQ ID NO: 375

SEQ ID NO: 412 - protein, 124 aa, synthetic construct; identical to SEQ ID NO: 307

SEQ ID NO: 413 - protein, 126 aa, synthetic construct; identical to SEQ ID NO: 373

SEQ ID NO: 414 - protein, 123 aa, synthetic construct; identical to SEQ ID NO: 372

SEQ ID NO: 415 - protein, 124 aa, synthetic construct; identical to SEQ ID NO: 306

SEQ ID NO: 416 - protein, 123 aa, synthetic construct; identical to SEQ ID NO: 300

SEQ ID NO: 417 - protein, 128 aa, synthetic construct; identical to SEQ ID NO: 305

SEQ ID NO: 418 - protein, 124 aa, synthetic construct; identical to SEQ ID NO: 368

SEQ ID NO: 419 - protein, 124 aa, synthetic construct; identical to SEQ ID NO: 367

SEQ ID NO: 420 - protein, 124 aa, synthetic construct; identical to SEQ ID NO: 366

SEQ ID NO: 421 - protein, 123 aa, synthetic construct; identical to SEQ ID NO: 365

SEQ ID NO: 422 - protein, 124 aa, synthetic construct; identical to SEQ ID NO: 364

SEQ ID NO: 423 - protein, 124 aa, synthetic construct; identical to SEQ ID NO: 363

SEQ ID NO: 424 - protein, 124 aa, synthetic construct; identical to SEQ ID NO: 321

SEQ ID NO: 425 - protein, 124 aa, synthetic construct; identical to SEQ ID NO: 361

SEQ ID NO: 426 - protein, 124 aa, synthetic construct; identical to SEQ ID NO: 331

SEQ ID NO: 427 - protein, 123 aa, synthetic construct; identical to SEQ ID NO: 359

SEQ ID NO: 428 - protein, 124 aa, synthetic construct; identical to SEQ ID NO: 358

SEQ ID NO: 429 - protein, 124 aa, synthetic construct; identical to SEQ ID NO: 357

SEQ ID NO: 430 - protein, 124 aa, synthetic construct; identical to SEQ ID NO: 356

SEQ ID NO: 431 - protein, 124 aa, synthetic construct; identical to SEQ ID NO: 355

SEQ ID NO: 432 - protein, 124 aa, synthetic construct; identical to SEQ ID NO: 354

SEQ ID NO: 433 - protein, 128 aa, synthetic construct; identical to SEQ ID NO: 353

SEQ ID NO: 434 - protein, 123 aa, synthetic construct; identical to SEQ ID NO: 352

SEQ ID NO: 435 - protein, 124 aa, synthetic construct; identical to SEQ ID NO: 351

SEQ ID NO: 436 - protein, 124 aa, synthetic construct; identical to SEQ ID NO: 350

SEQ ID NO: 437 - protein, 128 aa, synthetic construct; identical to SEQ ID NO: 349

SEQ ID NO: 438 - protein, 123 aa, synthetic construct; identical to SEQ ID NO: 348

SEQ ID NO: 439 - protein, 123 aa, synthetic construct; identical to SEQ ID NO: 347

SEQ ID NO: 440 - protein, 123 aa, synthetic construct; identical to SEQ ID NO: 346

SEQ ID NO: 441 - protein, 124 aa, synthetic construct; identical to SEQ ID NO: 345

SEQ ID NO: 442 - protein, 124 aa, synthetic construct; identical to SEQ ID NO: 344

SEQ ID NO: 443 - protein, 128 aa, synthetic construct; identical to SEQ ID NO: 343

SEQ ID NO: 444 - protein, 123 aa, synthetic construct; identical to SEQ ID NO: 342

SEQ ID NO: 445 - protein, 123 aa, synthetic construct; identical to SEQ ID NO: 341

SEQ ID NO: 446 - protein, 123 aa, synthetic construct; identical to SEQ ID NO: 340

SEQ ID NO: 447 - protein, 123 aa, synthetic construct; identical to SEQ ID NO: 339

SEQ ID NO: 448 - protein, 120 aa, synthetic construct; identical to SEQ ID NO: 338

SEQ ID NO: 449 - protein, 124 aa, synthetic construct; identical to SEQ ID NO: 337

SEQ ID NO: 450 - protein, 122 aa, synthetic construct; identical to SEQ ID NO: 336

SEQ ID NO: 451 - protein, 124 aa, synthetic construct; identical to SEQ ID NO: 325

SEQ ID NO: 452 - protein, 128 aa, synthetic construct; identical to SEQ ID NO: 304

SEQ ID NO: 453 - protein, 124 aa, synthetic construct
EVQLVESGGGLVQPGGSLRLSCAASGHTFRGYVMGWFRQAPGKEREFVAAISGRSGNTYYADSVKGRFTISADNSKNTAYLQMNSLKPEDTAVYYCAAGNGGRLYGHSRARYDWGQGTLVTVSS

SEQ ID NO: 454 - protein, 124 aa, synthetic construct
EVQLVESGGGLVQPGGSLRLSCAASGSIVRGNTMGWFRQAPGKEREFVAAISSSGSSTVYADSVKGRFTISADNSKNTAYLQMNSLKPEDTAVYYCAAGNGGRTYGHSRARYEWGQGTLVTVSS

SEQ ID NO: 455 - protein, 124 aa, synthetic construct
EVQLVESGGGLVQPGGSLRLSCAASGRTFSSYPMGWFRQAPGKEREFVAAISRSGGSTLYADSVKGRFTISADNSKNTAYLQMNSLKPEDTAVYYCAAGNGGRTYGHSRARYEWGQGTLVTVSS

SEQ ID NO: 456 - protein, 124 aa, synthetic construct
EVQLVESGGGLVQPGGSLRLSCAASGNIFGVNPMGWFRQAPGKEREFVAFISGTGGSTYYADSVKGRFTISADNSKNTAYLQMNSLKPEDTAVYYCAAGNGGRTYGHSRARYEWGQGTLVTVSS

SEQ ID NO: 457 - protein, 124 aa, synthetic construct
EVQLVESGGGLVQPGGSLRLSCAASGHTFRGYAMGWFRQAPGKEREFVAAINRSGSSTVYADSVKGRFTISADNSKNTAYLQMNSLKPEDTAVYYCAAGNGGRAYGYSRARYEWGQGTLVTVSS

SEQ ID NO: 458 - protein, 123 aa, synthetic construct
EVQLVESGGGLVQPGGSLRLSCAASGRTLRRYVMGWFRQAPGKERELVARIISDGNTYYADSVKGRFTISADNSKNTAYLQMNSLKPEDTAVYYCAAGNGGRQYGHSRARYDWGQGTLVTVSS

SEQ ID NO: 459 - protein, 123 aa, synthetic construct
EVQLVESGGGLVQPGGSLRLSCAASGRALSSSVMGWFRQAPGKERELVALLWSGGRTLYADSVKGRFTISADNSKNTAYLQMNSLKPEDTAVYYCAAGNGGRYYGHSRARYDWGQGTLVTVSS

SEQ ID NO: 460 - protein, 122 aa, synthetic construct
EVQLVESGGGLVQPGGSLRLSCAASGRTFSNGPMGWFRQAPGKEREWVASITSTGSTYADSVKGRFTISADNSKNTAYLQMNSLKPEDTAVYYCAAGNGGRLYGHSRARYDWGQGTLVTVSS

SEQ ID NO: 461 - protein, 122 aa, synthetic construct
EVQLVESGGGLVQPGGSLRLSCAASGLTFGSAPMGWFRQAPGKERELVAAITSGGRTYADSVKGRFTISADNSKNTAYLQMNSLKPEDTAVYYCAAGNGGRQYGHSRARYDWGQGTLVTVSS

SEQ ID NO: 462 - protein, 128 aa, synthetic construct
EVQLVESGGGLVQPGGSLRLSCAASGFTFGSTTMGWFRQAPGKEREFVAAVNWSGRRELYADSVKGRFTISADNSKNTAYLQMNSLKPEDTAVYYCAAAPRPKRVSVSYFYTSSNYDWGQGTLVTVSS

SEQ ID NO: 463 - protein, 123 aa, synthetic construct
EVQLVESGGGLVQPGGSLRLSCAASGRFTSSSPMGWFRQAPGKERELVASITSGGRTSYADSVKGRFTISADNSKNTAYLQMNSLKPEDTAVYYCAAGNGGRAYGYSRARYEWGQGTLVTVSS

SEQ ID NO: 464 - protein, 123 aa, synthetic construct
EVQLVESGGGLVQPGGSLRLSCAASGRTFNSRPMGWFRQAPGKERELVASITSDGSTYYADSVKGRFTISADNSKNTAYLQMNSLKPEDTAVYYCAAGNGGRQYGHSRARYDWGQGTLVTVSS

SEQ ID NO: 465 - protein, 121 aa, synthetic construct
EVQLVESGGGLVQPGGSLRLSCAASGRTLSSVMGWFRQAPGKEREFVATISQRGRRYADSVKGRFTISADNSKNTAYLQMNSLKPEDTAVYYCAAGNGGRQYGHSRARYDWGQGTLVTVSS

SEQ ID NO: 466 - protein, 124 aa, synthetic construct
EVQLVESGGGLVQPGGSLRLSCAASGGTFSRYAMGWFRQAPGKEREFVAAINRSGKSTYYADSVKGRFTISADNSKNTAYLQMNSLKPEDTAVYYCAAGNGGRQYGHSRARYDWGQGTLVTVSS

SEQ ID NO: 467 - protein, 123 aa, synthetic construct
EVQLVESGGGLVQPGGSLRLSCAASGRTFNSRPMGWFRQAPGKERELVATISSGSTTYYADSVKGRFTISADNSKNTAYLQMNSLKPEDTAVYYCAAGNGGRSYGHSRARYDWGQGTLVTVSS

SEQ ID NO: 468 - protein, 124 aa, synthetic construct
EVQLVESGGGLVQPGGSLRLSCAASGSTFRGAAMGWFRQAPGKEREFVAAITSAGGTTYYADSVKGRFTISADNSKNTAYLQMNSLKPEDTAVYYCAAGNGGRQYGHSRARYDWGQGTLVTVSS

SEQ ID NO: 469 - protein, 123 aa, synthetic construct
EVQLVESGGGLVQPGGSLRLSCAASGSTFSKAVMGWFRQAPGKERELVAGILSSGATVYADSVKGRFTISADNSKNTAYLQMNSLKPEDTAVYYCAAGNGGRHYGHSRARYDWGQGTLVTVSS

SEQ ID NO: 470 - protein, 124 aa, synthetic construct
EVQLVESGGGLVQPGGSLRLSCAASGTTFRINVMGWFRQAPGKEREFVGAISRSGGSTYYADSVKGRFTISADNSKNTAYLQMNSLKPEDTAVYYCAAGNGGRSYGHSRARYDWGQGTLVTVSS

SEQ ID NO: 471 - protein, 124 aa, synthetic construct
EVQLVESGGGLVQPGGSLRLSCAASGFPVNRYSMGWFRQAPGKEREFVAAISRSGGSTYYADSVKGRFTISADNSKNTAYLQMNSLKPEDTAVYYCAAGNGGRQYGHSRARYDWGQGTLVTVSS

SEQ ID NO: 472 - protein, 123 aa, synthetic construct
EVQLVESGGGLVQPGGSLRLSCAASGHTFNTYPMGWFRQAPGKERELVAAITSNGRPSYADSVKGRFTISADNSKNTAYLQMNSLKPEDTAVYYCAAGNGGRAYGYSRARYEWGQGTLVTVSS

SEQ ID NO: 473 - protein, 124 aa, synthetic construct
EVQLVESGGGLVQPGGSLRLSCAASGRTFGRRAMGWFRQAPGKEREFVAAINWSGGSTVYADSVKGRFTISADNSKNTAYLQMNSLKPEDTAVYYCAAGNGGRHYGHSRARYDWGQGTLVTVSS

SEQ ID NO: 474 - protein, 124 aa, synthetic construct
EVQLVESGGGLVQPGGSLRLSCAASGFTFSSYPMGWFRQAPGKEREFVALISRSGGTTFYADSVKGRFTISADNSKNTAYLQMNSLKPEDTAVYYCAAGNGGRNYGHSRARYDWGQGTLVTVSS

SEQ ID NO: 475 - protein, 123 aa, synthetic construct
EVQLVESGGGLVQPGGSLRLSCAASGRTFSNFAMGWFRQAPGKERELVAFSSSGGRTIYADSVKGRFTISADNSKNTAYLQMNSLKPEDTAVYYCAAGNGGRHYGHSRARYDWGQGTLVTVSS

SEQ ID NO: 476 - protein, 123 aa, synthetic construct
EVQLVESGGGLVQPGGSLRLSCAASGLTTVYTMGWFRQAPGKEREVVAAISRTGGSTYYADSVKGRFTISADNSKNTAYLQMNSLKPEDTAVYYCAAGNGGRTYGHSRARYEWGQGTLVTVSS

SEQ ID NO: 477 - protein, 124 aa, synthetic construct
EVQLVESGGGLVQPGGSLRLSCAASGTTFRINVMGWFRQAPGKEREFVAAINRSGKSTYYADSVKGRFTISADNSKNTAYLQMNSLKPEDTAVYYCAAGNGGRQYGHSRARYDWGQGTLVTVSS

SEQ ID NO: 478 - protein, 123 aa, synthetic construct
EVQLVESGGGLVQPGGSLRLSCAASGRTFSTHAMGWFRQAPGKEREFVAHITRLGVTYYADSVKGRFTISADNSKNTAYLQMNSLKPEDTAVYYCAAGNGGRAYGYSRARYEWGQGTLVTVSS

SEQ ID NO: 479 - protein, 124 aa, synthetic construct; identical to SEQ ID NO: 330

SEQ ID NO: 480 - protein, 128 aa, synthetic construct
EVQLVESGGGLVQPGGSLRLSCAASGRTFSSYVMGWFRQAPGKEREFVAAIDWSGSRSYYADSVKGRFTISADNSKNTAYLQMNSLKPEDTAVYYCAAAPRPKRVSVSYFYTSSNYDWGQGTLVTVSS

SEQ ID NO: 481 - protein, 128 aa, synthetic construct
EVQLVESGGGLVQPGGSLRLSCAASGRTFSDIAMGWFRQAPGKEREFVAAINWSGARTYYADSVKGRFTISADNSKNTAYLQMNSLKPEDTAVYYCAAAPRPKRVSVQYFSTSSNYDWGQGTLVTVSS

SEQ ID NO: 482 - protein, 124 aa, synthetic construct
EVQLVESGGGLVQPGGSLRLSCAASGIPFSTRTMGWFRQAPGKEREFVAAISWSGGSTIYADSVKGRFTISADNSKNTAYLQMNSLKPEDTAVYYCAAGNGGRQYGHSRARYDWGQGTLVTVSS

SEQ ID NO: 483 - protein, 128 aa, synthetic construct
EVQLVESGGGLVQPGGSLRLSCAASGFTFDEYAMGWFRQAPGKEREFVGAIDWSGRRITYADSVKGRFTISADNSKNTAYLQMNSLKPEDTAVYYCAAAPRPKRISVSYFSTSSNYDWGQGTLVTVSS

SEQ ID NO: 484 - protein, 128 aa, synthetic construct
EVQLVESGGGLVQPGGSLRLSCAASGFTFSNYAMGWFRQAPGKEREFVAAISWSGGSTVYADSVKGRFTISADNSKNTAYLQMNSLKPEDTAVYYCAAAPRPKRVSFSYFSTSSNYEWGQGTLVTVSS

SEQ ID NO: 485 - protein, 124 aa, synthetic construct
EVQLVESGGGLVQPGGSLRLSCAASGITFKRYAMGWFRQAPGKEREFVAAINWSGASTVYADSVKGRFTISADNSKNTAYLQMNSLKPEDTAVYYCAAGNGGRQYGHSRARYDWGQGTLVTVSS

SEQ ID NO: 486 - protein, 128 aa, synthetic construct
EVQLVESGGGLVQPGGSLRLSCAASGFTFGHYAMGWFRQAPGKEREFVAAISWSLTRTHYADSVKGRFTISADNSKNTAYLQMNSLKPEDTAVYYCAAAPRPKRVSVQYFSTSSNYDWGQGTLVTVSS

SEQ ID NO: 487 - protein, 124 aa, synthetic construct
EVQLVESGGGLVQPGGSLRLSCAASGSITSINPMGWFRQAPGKEREFVAAISRSGASAYYADSVKGRFTISADNSKNTAYLQMNSLKPEDTAVYYCAAGNGGRTYGHSRARYEWGQGTLVTVSS

SEQ ID NO: 488 - protein, 129 aa, synthetic construct
EVQLVESGGGLVQPGGSLRLSCAASGGRIFSNYAMGWFRQAPGKEREFVAAISWSGGSTYYADSVKGRFTISADNSKNTAYLQMNSLKPEDTAVYYCAAAPRPKRVSVSYFSTASNYDWGQGTLVTVSS

SEQ ID NO: 489 - protein, 122 aa, synthetic construct
EVQLVESGGGLVQPGGSLRLSCAASGRTFTMGWFRQAPGKEREFVAAINWRSGGSTYYADSVKGRFTISADNSKNTAYLQMNSLKPEDTAVYYCAAGNGGRTYGHSRARYEWGQGTLVTVSS

SEQ ID NO: 490 - protein, 124 aa, synthetic construct
EVQLVESGGGLVQPGGSLRLSCAASGGTFNGRAMGWFRQAPGKEREFVAAISRSGGGIYYADSVKGRFTISADNSKNTAYLQMNSLKPEDTAVYYCAAGNGGRQYGHSRARYDWGQGTLVTVSS

SEQ ID NO: 491 - protein, 128 aa, synthetic construct
EVQLVESGGGLVQPGGSLRLSCAASGFNFDDYAMGWFRQAPGKERELVAAISWSLSRTHYADSVKGRFTISADNSKNTAYLQMNSLKPEDTAVYYCAAAPRPKRVSVSYFSTASNYDWGQGTLVTVSS

SEQ ID NO: 492 - protein, 126 aa, synthetic construct
EVQLVESGGGLVQPGGSLRLSCAASSIGIAFSSRTMGWFRQAPGKEREFVAAVTRSGGKSYYADSVKGRFTISADNSKNTAYLQMNSLKPEDTAVYYCAAGNGGRSYGHSRARYDWGQGTLVTVSS

SEQ ID NO: 493 - protein, 123 aa, synthetic construct
EVQLVESGGGLVQPGGSLRLSCAASGSTFRINVMGWFRQAPGKEREFVAAISASGSALYADSVKGRFTISADNSKNTAYLQMNSLKPEDTAVYYCAAGNGGRTYGHSRARYEWGQGTLVTVSS

SEQ ID NO: 494 - protein, 124 aa, synthetic construct
EVQLVESGGGLVQPGGSLRLSCAASGGIYRVNTMGWFRQAPGKEREFVAAINWSGGSTVYADSVKGRFTISADNSKNTAYLQMNSLKPEDTAVYYCAAGNGGRQYGHSRARYDWGQGTLVTVSS

SEQ ID NO: 495 - protein, 123 aa, synthetic construct; identical to SEQ ID NO: 327

SEQ ID NO: 496 - protein, 124 aa, synthetic construct
EVQLVESGGGLVQPGGSLRLSCAASGRTFSNYAMGWFRQAPGKEREWVASISTSGKTTYYADSVKGRFTISADNSKNTAYLQMNSLKPEDTAVYYCAAGNGGRQYGHSRARYDWGQGTLVTVSS

SEQ ID NO: 497 - protein, 123 aa, synthetic construct
EVQLVESGGGLVQPGGSLRLSCAASGTTVRIRTMGWFRQAPGKEREFVAAINGGGNTYYADSVKGRFTISADNSKNTAYLQMNSLKPEDTAVYYCAAGNGGRQYGHSRARYDWGQGTLVTVSS

SEQ ID NO: 498 - protein, 124 aa, synthetic construct
EVQLVESGGGLVQPGGSLRLSCAASGRTFSTYSMGWFRQAPGKEREFVAAINWSGSSTVYADSVKGRFTISADNSKNTAYLQMNSLKPEDTAVYYCAAGNGGRHYGHSRARYDWGQGTLVTVSS

SEQ ID NO: 499 - protein, 123 aa, synthetic construct
EVQLVESGGGLVQPGGSLRLSCAASGIPFSTRTMGWFRQAPGKEREFVAAISSGATTLYADSVKGRFTISADNSKNTAYLQMNSLKPEDTAVYYCAAGNGGRHYGHSRARYDWGQGTLVTVSS

SEQ ID NO: 500 - protein, 124 aa, synthetic construct
EVQLVESGGGLVQPGGSLRLSCAASGRTFSRYAMGWFRQAPGKEREFVALIRIKDGSIYYADSVKGRFTISADNSKNTAYLQMNSLKPEDTAVYYCAAGNGGRQYGHSRARYDWGQGTLVTVSS

SEQ ID NO: 501 - protein, 124 aa, synthetic construct
EVQLVESGGGLVQPGGSLRLSCAASGHTFNTYPMGWFRQAPGKERELVAAISRSGGKLYYADSVKGRFTISADNSKNTAYLQMNSLKPEDTAVYYCAAGNGGRNYGHSRARYEWGQGTLVTVSS

SEQ ID NO: 502 - protein, 124 aa, synthetic construct
EVQLVESGGGLVQPGGSLRLSCAASGRSFSEYAMGWFRQAPGKEREFLAAISRDGAATYYADSVKGRFTISADNSKNTAYLQMNSLKPEDTAVYYCAAGNGGRKYGHHRARYDWGQGTLVTVSS

SEQ ID NO: 503 - protein, 124 aa, synthetic construct; identical to SEQ ID NO: 329

SEQ ID NO: 504 - protein, 124 aa, synthetic construct
EVQLVESGGGLVQPGGSLRLSCAASGRTFSRYAMGWFRQAPGKEREFVAAISWSGGSTLYADSVKGRFTISADNSKNTAYLQMNSLKPEDTAVYYCAAGNGGRQYGHSRARYDWGQGTLVTVSS

SEQ ID NO: 505 - protein, 124 aa, synthetic construct
EVQLVESGGGLVQPGGSLRLSCAASGSIFTINAMGWFRQAPGKERELVAAINWSGSSTVYADSVKGRFTISADNSKNTAYLQMNSLKPEDTAVYYCAAGNGGRKYGHHRARYDWGQGTLVTVSS

SEQ ID NO: 506 - protein, 124 aa, synthetic construct
EVQLVESGGGLVQPGGSLRLSCAASGTSISNRVMGWFRQAPGKERELVAGISSGGNLKAYADSVKGRFTISADNSKNTAYLQMNSLKPEDTAVYYCAAGNGGRQYGHSRARYDWGQGTLVTVSS

SEQ ID NO: 507 - protein, 124 aa, synthetic construct
EVQLLESGGGLVQPGGSLRLSCAASGFTFRRYVMGWVRQAPGKGLEWVSAIEGAGSDTYYADSVKGRFTISRDNSKNTLYLQMNSLRAEDTAVYYCAKQIPGRKWTANGRKDYWGQGTLVTVSS

SEQ ID NO: 508 - protein, 116 aa, synthetic construct
EVQLLESGGGLVQPGGSLRLSCAASGFTFNKYPMMWVRQAPGKGLEWVSEISPSGKKKYYADSVKGRFTISRDNSKNTLYLQMNSLRAEDTAVYYCAKYPKNFDYWGQGTLVTVSS

SEQ ID NO: 509 - protein, 119 aa, synthetic construct
EVQLLESGGGLVQPGGSLRLSCAASGFTFSSAAMSWVRQAPGKGLEWVAAISGGGADTYYADSVKGRFTISRDNSKNTLYLQMNSLRAEDTAVYYCARLPKRGPRFDYWGQGTLVTVSS

SEQ ID NO: 510 - protein, 124 aa, synthetic construct
EVQLLESGGGLVQPGGSLRLSCAASGFTFNKYPMMWVRQAPGKGLEWVSAIQQRGLKTAYADSVKGRFTISRDNSKNTLYLQMNSLRAEDTAVYYCAKGIRGWIGHDTQPFDYWGQGTLVTVSS

SEQ ID NO: 511 - protein, 116 aa, synthetic construct
EVQLLESGGGLVQPGGSLRLSCAASGFTFDRYRMMWVRQAPGKGLEWVSEISPSGKKKYYADSVKGRFTISRDNSKNTLYLQMNSLRAEDTAVYYCAKYPKNFDYWGQGTLVTVSS

SEQ ID NO: 512 - protein, 119 aa, synthetic construct
EVQLLESGGGLVQPGGSLRLSCAASGFTSNNFAMTWVRQAPGKGLEWVAAISGGGADTYYADSVKGRFTISRDNSKNTLYLQMNSLRAEDTAVYYCAKLQKRGPRFDYWGQGTLVTVSS

SEQ ID NO: 513 - protein, 119 aa, synthetic construct
EVQLLESGGGLVQPGGSLRLSCAASGFTFGNYAMAWVRQAPGKGLEWVSVISSSGGETSYADSVKGRFTISRDNSKNTLYLQMNSLRAEDTAVYYCVKAPLRSGGVDYWGQGTLVTVSS

SEQ ID NO: 514 - protein, 119 aa, synthetic construct
EVQLLESGGGLVQPGGSLRLSCAASGFTFDRYRMMWVRQAPGKGLEWVSEISPSGKKKYYADSVKGRFTISRDNSKNTLYLQMNSLRAEDTAVYYCAKFPSTHGKFDYWGQGTLVTVSS

SEQ ID NO: 515 - protein, 119 aa, synthetic construct
EVQLLESGGGLVQPGGSLRLSCAASGLTFPNYGMGWVRQAPGKGLEWVSSIDDRGRYTYYADSVKGRFTISRDNSKNTLYLQMNSLRAEDTAVYYCARVIAAAGAFDYWGQGTLVTVSS

SEQ ID NO: 516 - protein, 116 aa, synthetic construct
EVQLLESGGGLVQPGGSLRLSCAASGFTFNKYPMMWVRQAPGKGLEWVGYISNSGSTSYNDSVKGRFTISRDNSKNTLYLQMNSLRAEDTAVYYCAKRTRSKFDYWGQGTLVTVSS

SEQ ID NO: 517 - protein, 119 aa, synthetic construct
EVQLLESGGGLVQPGGSLRLSCAASGFTFTHYSMGWVRQAPGKGLEWVSGITRSGSTNYRDSVKGRFTISRDNSKNTLYLQMNSLRAEDTAVYYCAKRTENRGVSFDYWGQGTLVTVSS

SEQ ID NO: 518 - protein, 116 aa, synthetic construct
EVQLLESGGGLVQPGGSLRLSCAASGFTFEEKEMIWVRQAPGKGLEWVSMISSSGLWTYYADSVKGRFTISRDNSKNTLYLQMNSLRAEDTAVYYCAKGWRRFDYWGQGTLVTVSS

SEQ ID NO: 519 - protein, 115 aa, synthetic construct
EVQLLESGGGLVQPGGSLRLSCAASGFTFDRYRMMWVRQAPGKGLEWVSEISPSGKKKYYADSVKGRFTISRDNSKNTLYLQMNSLRAEDTAVYYCAKYTWNGYWGQGTLVTVSS

SEQ ID NO: 520 - protein, 114 aa, synthetic construct
EVQLLESGGGLVQPGGSLRLSCAASGFTFHKYGMAWVRQAPGKGLEWVSEISPSGKKKYYADSVKGRFTISRDNSKNTLYLQMNSLRAEDTAVYYCASLSRGYWGQGTLVTVSS

SEQ ID NO: 521 - protein, 117 aa, synthetic construct
EVQLLESGGGLVQPGGSLRLSCAASGFTFGNYAMAWVRQAPGKGLEWVSSIWPRGQKTYYADSVKGRFTISRDNSKNTLYLQMNSLRAEDTAVYYCAKFRGRGFDYWGQGTLVTVSS

SEQ ID NO: 522 - protein, 116 aa, synthetic construct
EVQLLESGGGLVQPGGSLRLSCAASGFTFAKYKMWWVRQAPGKGLEWVSEISPSGKKKYYADSVKGRFTISRDNSKNTLYLQMNSLRAEDTAVYYCAKAHNAFDYWGQGTLVTVSS

SEQ ID NO: 523 - protein, 115 aa, synthetic construct
EVQLLESGGGLVQPGGSLRLSCAASGFTFSSYFMSWVRQAPGKGLEWVSAISGGGADTYYADSVKGRFTISRDNSKNTLYLQMNSLRAEDTAVYYCARGNYFDYWGQGTLVTVSS

SEQ ID NO: 524 - protein, 117 aa, synthetic construct
EVQLLESGGGLVQPGGSLRLSCAASGFTFDRYRMMWVRQAPGKGLEWVSSISGYGSTTYYADSVKGRFTISRDNSKNTLYLQMNSLRAEDTAVYYCAKFRGRGFDYWGQGTLVTVSS

SEQ ID NO: 525 - protein, 122 aa, synthetic construct
EVQLLESGGGLVQPGGSLRLSCAASGFTFSRYAMNWVRQAPGKGLEWVSSIGANGAPTYYADSVKGRFTISRDNSKNTLYLQMNSLRAEDTAVYYCAKDKRYRGSQHYFDYWGQGTLVTVSS

SEQ ID NO: 526 - protein, 116 aa, synthetic construct
EVQLLESGGGLVQPGGSLRLSCAASGFTFRSYTMGWVRQAPGKGLEWVSSISNSGGSTYYADSVKGRFTISRDNSKNTLYLQMNSLRAEDTAVYYCAKAGRKFDYWGQGTLVTVSS

SEQ ID NO: 527 - protein, 119 aa, synthetic construct
EVQLLESGGGLVQPGGSLRLSCAASGFTFSDYDMSWVRQAPGKGLEWVSDIGASGSATSYADSVKGRFTISRDNSKNTLYLQMNSLRAEDTAVYYCAKQSGSEDHFDYWGQGTLVTVSS

SEQ ID NO: 528 - protein, 122 aa, synthetic construct
EVQLLESGGGLVQPGGSLRLSCAASGFTFRRYVMGWVRQAPGKGLEWVSEISPSGKKKYYADSVKGRFTISRDNSKNTLYLQMNSLRAEDTAVYYCAKWRREGYTGSKFDYWGQGTLVTVSS

SEQ ID NO: 529 - protein, 118 aa, synthetic construct
EVQLLESGGGLVQPGGSLRLSCAASGGFSLSRYMHWVRQAPGKGLEWVSTINQAGLRTYYADSVKGRFTISRDNSKNTLYLQMNSLRAEDTAVYYCAKSRTGRYFDYWGQGTLVTVSS

SEQ ID NO: 530 - protein, 116 aa, synthetic construct
EVQLLESGGGLVQPGGSLRLSCAASGFTFHKYGMAWVRQAPGKGLEWVGYINPSRGYTYYADSVKGRFTISRDNSKNTLYLQMNSLRAEDTAVYYCAKGYRHFDYWGQGTLVTVSS

SEQ ID NO: 531 - protein, 117 aa, synthetic construct
EVQLLESGGGLVQPGGSLRLSCAASGFTFNKYPMMWVRQAPGKGLEWVSVISSSGGETSYADSVKGRFTISRDNSKNTLYLQMNSLRAEDTAVYYCAKDLGQGFDYWGQGTLVTVSS

SEQ ID NO: 532 - protein, 117 aa, synthetic construct
EVQLLESGGGLVQPGGSLRLSCAASGFTFNKYPMMWVRQAPGKGLEWVSYISSSGSSTYYADSVKGRFTISRDNSKNTLYLQMNSLRAEDTAVYYCAKRTRSKFDYWGQGTLVTVSS

SEQ ID NO: 533 - protein, 119 aa, synthetic construct
EVQLLESGGGLVQPGGSLRLSCAASGFTFRRYVMGWVRQAPGKGLEWVAAISGGGADTYYADSVKGRFTISRDNSKNTLYLQMNSLRAEDTAVYYCAGLPKRGPRFDYWGQGTLVTVSS

SEQ ID NO: 534 - protein, 119 aa, synthetic construct
EVQLLESGGGLVQPGGSLRLSCAASGFTFSRYAMNWVRQAPGKGLEWVSYIGPSGGKTYYADSVKGRFTISRDNSKNTLYLQMNSLRAEDTAVYYCARLPKRGPWFDYWGQGTLVTVSS

SEQ ID NO: 535 - protein, 116 aa, synthetic construct
EVQLLESGGGLVQPGGSLRLSCAASGFTFRRYVMGWVRQAPGKGLEWVAAISGGGADTYYADSVKGRFTISRDNSKNTLYLQMNSLRAEDTAVYYCAKPSRRFDYWGQGTLVTVSS

SEQ ID NO: 536 - protein, 117 aa, synthetic construct
EVQLLESGGGLVQPGGSLRLSCAASGFTFSSYVMIWVRQAPGKGLEWVSAIQQRGLKTAYADSVKGRFTISRDNSKNTLYLQMNSLRAEDTAVYYCARSGPYYFDYWGQGTLVTVSS

SEQ ID NO: 537 - protein, 116 aa, synthetic construct
EVQLLESGGGLVQPGGSLRLSCAASGFTFEDYQMGWVRQAPGKGLEWVSAITGTGGETYYADSVKGRFTISRDNSKNTLYLQMNSLRAEDTAVYYCAKPGHRFDYWGQGTLVTVSS

SEQ ID NO: 538 - protein, 121 aa, synthetic construct
EVQLLESGGGLVQPGGSLRLSCAASGFTFRRYVMGWVRQAPGKGLEWVSGIYPSGGSTVYADSVKGRFTISRDNSKNTLYLQMNSLRAEDTAVYYCAKDRYSQVHYALDYWGQGTLVTVSS

SEQ ID NO: 539 - protein, 121 aa, synthetic construct
EVQLLESGGGLVQPGGSLRLSCAASGFTFKAYEIGWVRQAPGKGLEWVSGISPSGGITTYADSVKGRFTISRDNSKNTLYLQMNSLRAEDTAVYYCARHRAGSSGWYSDYWGQGTLVTVSS

SEQ ID NO: 540 - protein, 120 aa, synthetic construct
EVQLLESGGGLVQPGGSLRLSCAASGFTFEVYTMAWVRQAPGKGLEWVSAISGRGDNTYYADSVKGRFTISRDNSKNTLYLQMNSLRAEDTAVYYCAKRTENRGVSFDYWGQGTLVTVSS

SEQ ID NO: 541 - protein, 117 aa, synthetic construct
EVQLLESGGGLVQPGGSLRLSCAASGFTFGNYSMAWVRQAPGKGLEWVSNIWPRGQKTYYADSVKGRFTISRDNSKNTLYLQMNSLRAEDTAVYYCAKVTGRGFDYWGQGTLVTVSS

SEQ ID NO: 542 - protein, 117 aa, synthetic construct
EVQLLESGGGLVQPGGSLRLSCAASGFTFRRYVMGWVRQAPGKGLEWVADVNPNSGTSIYNDSVKGRFTISRDNSKNTLYLQMNSLRAEDTAVYYCAKGPGTRGDYWGQGTLVTVSS

SEQ ID NO: 543 - protein, 118 aa, synthetic construct
EVQLLESGGGLVQPGGSLRLSCAASGFTFSNYGVSWVRQAPGKGLEWVSSISPSGGWTEYADSVKGRFTISRDNSKNTLYLQMNSLRAEDTAVYYCARYGAYFGLDYWGQGTLVTVSS

SEQ ID NO: 544 - protein, 122 aa, synthetic construct
EVQLLESGGGLVQPGGSLRLSCAASGFTFAHEPMVWVRQAPGKGLEWVGKINYAGNTDYNDSVKGRFTISRDNSKNTLYLQMNSLRAEDTAVYYCAKKDYDYVWGSPYFDYWGQGTLVTVSS

SEQ ID NO: 545 - protein, 121 aa, synthetic construct
EVQLLESGGGLVQPGGSLRLSCAASGFTFHESTMTWVRQAPGKGLEWVSVISSSGGETSYADSVKGRFTISRDNSKNTLYLQMNSLRAEDTAVYYCARIRVGPSGGAFDYWGQGTLVTVSS

SEQ ID NO: 546 - protein, 119 aa, synthetic construct
EVQLLESGGGLVQPGGSLRLSCAASGFTFNKYPMMWVRQAPGKGLEWVSEISPSGKKKYYADSVKGRFTISRDNSKNTLYLQMNSLRAEDTAVYYCAKFPSSQFRFDYWGQGTLVTVSS

SEQ ID NO: 547 - protein, 116 aa, synthetic construct
EVQLLESGGGLVQPGGSLRLSCAASGFTFNKYPMMWVRQAPGKGLEWVSEISPSGKKKYYADSVKGRFTISRDNSKNTLYLQMNSLRAEDTAVYYCAKYPKNFNYWGQGTLVTVSS

SEQ ID NO: 548 - protein, 121 aa, synthetic construct
KVQLLESGGGLVQPGGSLRLSCAASGFTFHKYGMAWVRQAPGKGLEWVGKINYAGNTDYNDSVKGRFTISRDNSKNTLYLQMNSLRAEDTAVYYCAKDKRYRGSQHYFDYWGQGTLVTVSS

SEQ ID NO: 549 - protein, 117 aa, synthetic construct
EVQLLESGGGLVQPGGSLRLSCAASGLTFPNYGMGWVRQAPGKGLEWVSEISPSGKKKYYADSVKGRFTISRDNSKNTLYLQMNSLRAEDTAVYYCAREGLWAFDYWGQGTLVTVSS

SEQ ID NO: 550 - protein, 121 aa, synthetic construct
  VARIANT 76: note = Any amino acid
EVQLLESGGGLVQPGGSLRLSCAASGFTFKAYEIGWVRQAPGKGVEWGSGIIPNGGITTYADSVKGRFTISRDNSXNTLYLLMNSLIAEDAAVYYCGRHRAGSIGWYSDYWGQGTLVTVSS

SEQ ID NO: 551 - protein, 117 aa, synthetic construct
EVQLLESGGGLVQPGGSLRLSCAASGFTFRRYVMGWVRQAPGKGLEWVSDIGASGSATSYADSVKGRFTISRDNSKNTLYLQMNSLRAEDTAVYYCAKRTRSKFDYWGQGTLVTVSS

SEQ ID NO: 552 - protein, 116 aa, synthetic construct
EVQLLESGGGLVQPGGSLRLSCAASGFTFRRYVMGWVRQAPGKGLEWVAAISGGGADTYYADSVKGRFTISRDNSKNTLYLQMNSLRAEDTAVYYCAKGRRRFDYWGQGTLVTVSS

SEQ ID NO: 553 - protein, 119 aa, synthetic construct; identical to SEQ ID NO: 512

SEQ ID NO: 554 - protein, 117 aa, synthetic construct
EVQLLESGGGLVQPGGSLRLSCAASGFTFGNYAMAWVRQAPGKGLEWVSTIWARGQKTYYADSVKGRFTISRDNSKNTLYLQMNSLRAEDTAVYYCAHLPGRGFEYWGRGTRTPVSS

SEQ ID NO: 555 - protein, 116 aa, synthetic construct
EVQLLESGGGLVQPGGSLRLSCAASGFTFEDETMSWVRQAPGKGLEWVSAIISSGGLTYYADSVKGRFTISRDNSKNTLYLQMNSLRAEDTAVYYCAKGFRIFDYWGQGTLVTVSS

SEQ ID NO: 556 - protein, 116 aa, synthetic construct
EVQLLESGGGLVQPGGSLRLSCAASGFTFSNSYISWVRQAPGKGLEWVSYITPKGDHTYYADSVKGRFTISRDNSKNTLYLQMNSLRAEDTAVYYCAKGARRFDYWGQGTLVTVSS

SEQ ID NO: 557 - protein, 116 aa, synthetic construct
EVQLLESGGGLVQPGGSLRLSCAASGFTFSGYDMQWVRQAPGKGLEWVSSIGRHGGRTYYADSVKGRFTISRDNSKNTLYLQMNSLRAEDTAVYYCAKSLGRFDYWGQGTLVTVSS

SEQ ID NO: 558 - protein, 119 aa, synthetic construct
EVQLLESGGGLVQPGGSLRLSCAASGFTFRRYVMGWVRQAPGKGLEWVSAIEGAGSDTYYADSVKGRFTISRDNSKNTLYLQMNSLRAEDTAVYYCARLPKRGPRFDYWGQGTLVTVSS

SEQ ID NO: 559 - protein, 120 aa, synthetic construct
EVQLLESGGGLVQPGGSLRLSCAASGFTFKSYGMHWVRQAPGKGLEWVSSIWPRGQKTYYADSVKGRFTISRDNSKNTLYLQMNSLRAEDTAVYYCAKSGTRIKQGFDYWGQGTLVTVSS

SEQ ID NO: 560 - protein, 119 aa, synthetic construct
EVQLLESGGGLVQPGGSLRLSCAASGFTFRRYVMGWVRQAPGKGLEWVAAISGGGADTYYADSVKGRFTISRDNSKNTLYLQMNSLRAEDTAVYYCARLPKRGPRFDYWGQGTLVTVSS

SEQ ID NO: 561 - protein, 116 aa, synthetic construct
EVQLLESGGGLVQPGGSLRLSCAASGFTFVAYNMGWVRQAPGKGLEWVSSISNSGGSTYYADSVKGRFTISRDNSKNTLYLQMNSLRAEDTAVYYCAKNRAKFDYWGQGTLVTVSS

SEQ ID NO: 562 - protein, 119 aa, synthetic construct
EVQLLESGGGLVQPGGSLRLSCAASGFTFRRYVMGWVRQAPGKGLEWVSVISSSGGETSYADSVKGRFTISRDNSKNTLYLQMNSLRAEDTAVYYCAKLPKRGPRFDYWGQGTLVTVSS

SEQ ID NO: 563 - protein, 117 aa, synthetic construct
EVQLLESGGGLVQPGGSLRLSCAASGFTFRRYVMGWVRQAPGKGLEWVSAIEGAGSDTYYADSVKGRFTISRDNSKNTLYLQMNSLRAEDTAVYYCAKFRGRGFDYWGQGTLVTVSS

SEQ ID NO: 564 - protein, 117 aa, synthetic construct
EVQLLESGGGLVQPGGSLRLSCAASGFTFSRYGMHWVRQAPGKGLEWVAVISYGGSNKYYADSVKGRFTISRDNSKNTLYLQMNSLRAEDTAVYYCAKGVRKGFDYWGQGTLVTVSS

SEQ ID NO: 565 - protein, 117 aa, synthetic construct
EVQLLESGGGLVQPGGSLRLSCAASGFTFGNYAMAWVRQAPGKGLEWVSAIQQRGLKTAYADSVKGRFTISRDNSKNTLYLQMNSLRAEDTAVYYCARGYRGYFDYWGQGTLVTVSS

SEQ ID NO: 566 - protein, 117 aa, synthetic construct
EVQLLESGGGLVQPGGSLRLSCAASGYSISSGYHWAWVRQAPGKGLEWVSSIDDRGRYTYYADSVKGRFTISRDNSKNTLYLQMNSLRAEDTAVYYCAKSNGRFDYWGQGTLVTVSS

SEQ ID NO: 567 - protein, 117 aa, synthetic construct
EVQLLESGGGLVQPGGSLRLSCAASGFTFRRYVMGWVRQAPGKGLEWVSAISGSGGGTSYADSVKGRFTISRDNSKNTLYLQMNSLRAEDTAVYYCAKYFHGKFDYWGQGTLVTVSS

SEQ ID NO: 568 - protein, 117 aa, synthetic construct
EVQLLESGGGLVQPGGSLRLSCAASGFTFHKYGMAWVRQAPGKGLEWVSEISPSGKKKYYADSVKGRFTISRDNSKNTLYLQMNSLRAEDTAVYYCAKGRWSIFDYWGQGTLVTVSS

SEQ ID NO: 569 - protein, 117 aa, synthetic construct
EVQLLESGGGLVQPGGSLRLSCAASGFTFRRYVMGWVRQAPGKGLEWVADVNPNSGASIYNDSVKGRFTISRDNSKNTLYLQMNSLRAEDTAVYYCAKGPGTRGDYWGQGTLVTVSS

SEQ ID NO: 570 - protein, 117 aa, synthetic construct
EVQLLESGGGLVQPGGSLRLSCAASGFTFNKYPMMWVRQAPGKGLEWVSGIYPSGGSTVYDDSVKGRFTISRDNSKNTLYLQMNSLRAEDTAVYYCAKWSSRAFDYWGQGTLVTVSS

SEQ ID NO: 571 - protein, 119 aa, synthetic construct; identical to SEQ ID NO: 558

SEQ ID NO: 572 - protein, 119 aa, synthetic construct; identical to SEQ ID NO: 558

SEQ ID NO: 573 - protein, 116 aa, synthetic construct
EVQLLESGGGLVQPGGSLRLSCAASGFTFSSYVMIWVRQAPGKGLEWVSEISPSGKKKYYADSVKGRFTISRDNSKNTLYLQMNSLRAEDTAVYYCAKYPKNFDYWGQGTLVTVSS

SEQ ID NO: 574 - protein, 119 aa, synthetic construct; identical to SEQ ID NO: 560

SEQ ID NO: 575 - protein, 120 aa, synthetic construct
EVQLLESGGGLVQPGGSLRLSCAASGFTSNNFAMTWVRQAPGKGLEWVGYINPSRGYTYYADSVKGRFTISRDNSKNTLYLQMNSLRAEDTAVYYCAKRTENRGVSFDYWGQGTLVTVSS

SEQ ID NO: 576 - protein, 117 aa, synthetic construct
EVQLLESGGGLVQPGGSLRLSCAASGFTFNKYPMMWVRQAPGKGLEWVSEISPSGKKKYYADSVKGRFTISRDNSKNTLYLQMNSLRAEDTAVYYCAKFRGRGFDYWGQGTLVTVSS

SEQ ID NO: 577 - protein, 119 aa, synthetic construct
EVQLLESGGGLVQPGGSLRLSCAASGFTFFPYAMGWVRQAPGKGLEWVAAISGGGADTYYADSVKGRFTISRDNSKNTLYLQMNSLRAEDTAVYYCARLPKRGPRFDYWGQGTLVTVSS

SEQ ID NO: 578 - protein, 118 aa, synthetic construct
EVQLLESGGGLVQPGGSLRLSCAASGFTFDQYDMSWVRQAPGKGLEWVSAITGSGGSTYYADSVKGRFTISRDNSKNTLYLQMNSLRAEDTAVYYCATAESDDTYDYWGQGTLVTVSS

SEQ ID NO: 579 - protein, 119 aa, synthetic construct; identical to SEQ ID NO: 558

SEQ ID NO: 580 - protein, 119 aa, synthetic construct
EVQLLESGGGLVQPGGSLRLSCAASGFTFRSYTMVWVRQAPGKGLEWVSAITGTGGETYYADSVKGRFTISRDNSKNTLYLQMNSLRAEDTAVYYCARLPKRGPRFDYWGQGTLVTVSS

SEQ ID NO: 581 - protein, 117 aa, synthetic construct
EVQLLESGGGLVQPGGSLRLSCAASGFTFRRYVMGWVRQAPGKGLEWVSAIEARGGGTYYADSVKGRFTISRDNSKNTLYLQMNSLRAEDTAVYYCAKFRGRGFDYWGQGTLVTVSS

SEQ ID NO: 582 - protein, 122 aa, synthetic construct
EVQLLESGGGLVQPGGSLRLSCAASGFTFGNYAMAWVRQAPGKGLEWVSSIWPSGGQTWYADSVKGRFTISRDNSKNTLYLQMNSLRAEDTAVYYCAKDKRYRGSQHYFDYWGQGTLVTVSS

SEQ ID NO: 583 - protein, 115 aa, synthetic construct
EVQLLESGGGLVQPGGSLRLSCAASGFTFNKYPMMWVRQAPGKGLEWVGISNSGSTSYNDSVKGRFTISRDNSKNTLYLQMNSLRAEDTAVYYCAKRTRSKFDYWGQGTLVTVSS

SEQ ID NO: 584 - protein, 116 aa, synthetic construct
EVQLLESGGGLVQPGGSLRLSCAASGFTFHKYGMAWVRQAPGKGLEWVSSIGRHGGRTYYADSVKGRFTISRDNSKNTLYLQMNSLRAEDTAVYYCAKAGSGFDYWGQGTLVTVSS

SEQ ID NO: 585 - protein, 118 aa, synthetic construct
EVQLLESGGGLVQPGGSLRLSCAASGFTFSSYWNHWVRQAPGKGLEWVSTIGPSGTSTYYADSVKGRFTISRDNSKNTLYLQMNSLRAEDTAVYYCAESFRSRYFDYWGQGTLVTVSS

SEQ ID NO: 586 - protein, 114 aa, synthetic construct
EVQLLESGGGLVQPGGSLRLSCAASGFTFGNYAMAWVRQAPGKGLEWVSSIWPRGQKTYYADSVKGRFTISRDNSKNTLYLQMNSLRAEDTAVYYCASLSRGYWGQGTLVTVSS

SEQ ID NO: 587 - protein, 119 aa, synthetic construct
EVQLLESGGGLVQPGGSLRLSCAASGFTFRSYTMGWVRQAPGKGLEWVAAISGGGADTYYADSVKGRFTISRDNSKNTLYLQMNSLRAEDTAVYYCAKLPKRGPRFDYWGQGTLVTVSS

SEQ ID NO: 588 - protein, 120 aa, synthetic construct
EVQLLESGGGLVQPGGSLRLSCAASGFTFSRYFMGWVRQAPGKGLEWVSAISGRGDNTYYADSVKGRFTISRDNSKNTLYLQMNSLRAEDTAVYYCAKRTENRGVSFDYWGQGTLVTVSS

SEQ ID NO: 589 - protein, 116 aa, synthetic construct
EVQLLESGGGLVQPGGSLRLSCAASGFTFNKYPMMWVRQAPGKGLEWVGAIQQRGLKTAYADSVKGRFTISRDNSKNTLYLQMNSLRAEDTAVYYCARWTSGLDYWGQGTLVTVSS

SEQ ID NO: 590 - protein, 116 aa, synthetic construct
EVQLLESGGGLVQPGGSLRLSCAASGFTFSRYFMGWVRQAPGKGLEWVSEIDALGTDTYYADSVKGRFTISRDNSKNTLYLQMNSLRAEDTAVYYCAKGLRRFDYWGQGTLVTVSS

SEQ ID NO: 591 - protein, 117 aa, synthetic construct
EVQLLESGGGLVQPGGSLRLSCAASGFTFDRYRMMWVRQAPGKGLEWVSSISSTGFKTYYADSVKGRFTISRDNSKNTLYLQMNSLRAEDTAVYYCAKFRGRGFDYWGQGTLVTVSS

SEQ ID NO: 592 - protein, 119 aa, synthetic construct
EVQLLESGGGLVQPGGSLRLSCAASGFTFTHYSMGWVRQAPGKGLEWVSAINGTGGETYYADSVKGRFTISRDNSKNTLYLQMNSLRAEDTAVYYCARLPKRGPRFDYWGQGTLVTVSS

SEQ ID NO: 593 - protein, 116 aa, synthetic construct
EVQLLESGGGLVQPGGSLRLSCAASGFTFSPYLMSWVRQAPGKGLEWVSTIGPSGTSTYYADSVKGRFTISRDNSKNTLYLQMNSLRAEDTAVYYCAKGRRIFDYWGQGTLVTVSS

SEQ ID NO: 594 - protein, 118 aa, synthetic construct
EVQLLESGGGLVQPGGSLRLSCAASGFTFSNYFMIWVRQAPGKGLEWVSSIDDRGRYTYYADSVKGRFTISRDNSKNTLYLQMNSLRAEDTAVYYCARGGDYGSGDYWGQGTLVTVSS

SEQ ID NO: 595 - protein, 119 aa, synthetic construct
EVQLLESGGGLVQPGGSLRLSCAASGFTFRRYVMGWVRQAPGKGLEWVAAISGGGADTYYADSVKGRFTISRDNSKNTLYLQMNSLRAEDTAVYYCARPPKRGPRFDYWGQGTLVTVSS

SEQ ID NO: 596 - protein, 117 aa, synthetic construct
EVQLLESGGGLVQPGGSLRLSCAASGFTFNKYPMMWVRQAPGKGLEWVSVISSSGGETSYADSVKGRFTISRDNSKNTLYLQMNSLRAEDTAVYYCAKRTRSKFDYWGQGTLVTVSS

SEQ ID NO: 597 - protein, 118 aa, synthetic construct
EVQLLESGGGLVQPGGSLRLSCAASGFTFKSYGMHWVRQAPGKGLEWVSSIGRHGGRTYYADSVKGRFTISRDNSKNTLYLQMNSLRAEDTAVYYCARGGDYGSGDYWGQGTLVTVSS

SEQ ID NO: 598 - protein, 117 aa, synthetic construct
EVQLLESGGGLVQPGGSLRLSCAASGFTFNKYPMMWVRQAPGKGLEWVSYIGPSGGKTYYADSVKGRFTISRDNSKNTLYLQMNSLRAEDTAVYYCAKRTRSKFDYWGQGTLVTVSS

SEQ ID NO: 599 - protein, 119 aa, synthetic construct; identical to SEQ ID NO: 595

SEQ ID NO: 600 - protein, 116 aa, synthetic construct; identical to SEQ ID NO: 555

SEQ ID NO: 601 - protein, 116 aa, synthetic construct
EVQLLESGGGLVQPGGSLRLSCAASGFTFNKYPMMWVRQAPGKGLEWVSGITRSGSTNYRDSVKGRFTISRDNSKNTLYLQMNSLRAEDTAVYYCAKWSSRAFDYWGQGTLVTVSS

SEQ ID NO: 602 - protein, 121 aa, synthetic construct
EVQLLESGGGLVQPGGSLRLSCAASGFTFRRYVMGWVRQAPGKGLEWVAAISGGGADTYYADSVKGRFTISRDNSKNTLYLQMNSLRAEDTAVYYCAKHSKSSHRQSFDYWGQGTLVTVSS

SEQ ID NO: 603 - protein, 116 aa, synthetic construct
EVQLLESGGGLVQPGGSLRLSCAASGFTFNKYPMMWVRQAPGKGLEWVSEISPSGKKKYYADSVKGRFTISRDNSKNTLYLQMNSLRAEDTAVYYCAKLTGRFDYWGQGTLVTVSS

SEQ ID NO: 604 - protein, 116 aa, synthetic construct
EVQLLESGGGLVQPGGSLRLSCAASGFTFSRYFMGWVRQAPGKGLEWVSEISPSGKKKYYADSVKGRFTISRDNSKNTLYLQMNSLRAEDTAVYYCAKSGAYFDYWGQGTLVTVSS

SEQ ID NO: 605 - protein, 117 aa, synthetic construct
EVQLLESGGGLVQPGGSLRLSCAASGFTFNKYPMMWVRQAPGKGLEWVSWIEGRGTETYYADSVKGRFTISRDNSKNTLYLQMNSLRAEDTAVYYCAKRTRSKFDYWGQGTLVTVSS

SEQ ID NO: 606 - protein, 116 aa, synthetic construct
EVQLLESGGGLVQPGGSLRLSCAASGFTFHKYGMAWVRQAPGKGLEWVSEISPSGKKKYYADSVKGRFTISRDNSKNTLYLQMNSLRAEDTAVYYCAKYPKNFDYWGQGTLVTVSS

SEQ ID NO: 607 - protein, 117 aa, synthetic construct
EVQLLESGGGLVQPGGSLRLSCAASGFTFRRYVMGWVRQAPGKGLEWVSEISPSGKKKYYADSVKGRFTISRDNSKNTLYLQMNSLRAEDTAVYYCAKGVRKKFDYWGQGTLVTVSS

SEQ ID NO: 608 - protein, 119 aa, synthetic construct; identical to SEQ ID NO: 560

SEQ ID NO: 609 - protein, 120 aa, synthetic construct
EVQLLESGGGLVQPGGSLRLSCAASGFTFGNYAMAWVRQAPGKGLEWVSYISPIGPRTYYADSVKGRFTISRDNSKNTLYLQMNSLRAEDTAVYYCAKRTENRGVSFDYWGQGTLVTVSS

SEQ ID NO: 610 - protein, 119 aa, synthetic construct
EVQLLESGGGLVQPGGSLRLSCAASGFTLDYLAIGWVRQAPGKGLEWVSEISPSGKKKYYADSVKGRFTISRDNSKNTLYLQMNSLRAEDTAVYYCAKYTGRWEPFDYWGQGTLVTVSS

SEQ ID NO: 611 - protein, 119 aa, synthetic construct
EVQLLESGGGLVQPGGSLRLSCAASGFTFTHYSMGWVRQAPGKGLEWVAAISGGGADTYYADSVKGRFTISRDNSKNTLYLQMNSLRAEDTAVYYCARLPKRGPRFDYWGQGTLVTVSS

SEQ ID NO: 612 - protein, 119 aa, synthetic construct
EVQLLESGGGLVQPGGSLRLSCAASGFTFRRYVMGWVRQAPGKGLEWVSAITGTGGETYYADSVKGRFTISRDNSKNTLYLQMNSLRAEDTAVYYCARLPKRGPRFDYWGQGTLVTVSS

SEQ ID NO: 613 - protein, 123 aa, synthetic construct
EVQLLESGGGLVQPGGSLRLSCAASGFTFRRYVMGWVRQAPGKGLEWVSTISPSGHGTYYADSVKGRFTISRDNSKNTLYLQMNSLRAEDTAVYYCARRTGREYGGGWYFDYWGQGTLVTVSS

SEQ ID NO: 614 - protein, 116 aa, synthetic construct
EVQLLESGGGLVQPGGSLRLSCAASGFTFPVYNMAWVRQAPGKGLEWVSSISESGTTTYYADSVKGRFTISRDNSKNTLYLQMNSLRAEDTAVYYCAKNRAKFDYWGQGTLVTVSS

SEQ ID NO: 615 - protein, 119 aa, synthetic construct; identical to SEQ ID NO: 560

SEQ ID NO: 616 - protein, 116 aa, synthetic construct
EVQLLESGGGLVQPGGSLRLSCAASGFSFSAYAMNWVRQAPGKGLEWVSSISTSGGSTYYADSVKGRFTISRDNSKNTLYLQMNSLRAEDTAVYYCARGRAGADYWGQGTLVTVSS

SEQ ID NO: 617 - protein, 118 aa, synthetic construct
EVQLLESGGGLVQPGGSLRLSCAASGFTFSRFAMSWVRQAPGKGLEWVSAISGSGAYTYYADSVKGRFTISRDNSKNTLYLQMNSLRAEDTAVYYCARDIAAASFDYWGQGTLVTVSS

SEQ ID NO: 618 - protein, 119 aa, synthetic construct
EVQLLESGGGLVQPGGSLRLSCAASGFTFTSYAMTWVRQAPGKGLEWVSGVSGSGGTTYYADSVKGRFTISRDNSKNTLYLQMNSLRAEDTAVYYCAISYHFDYYFDYWGQGTLVTVSS

SEQ ID NO: 619 - protein, 124 aa, synthetic construct
EVQLLESGGGLVQPGGSLRLSCAASGFTFSSYAMNWVRQAPGKGLEWVSAISGGGGATYYADSVKGRFTISRDNSKNTLYLQMNSLRAEDTAVYYCARECSGGSCSYYYGMDVWGQGTLVTVSS

SEQ ID NO: 620 - protein, 124 aa, synthetic construct
EVQLLESGGGLVQPGGSLRLSCAASGSTFNNYAMSWVRQAPGKGLEWVSAISGSGSTTYYADSVKGRFTISRDNSKNTLYLQMNSLRAEDTAVYYCARLAVSTSDYYYYGMDVWGQGTLVTVSS

SEQ ID NO: 621 - protein, 124 aa, synthetic construct
EVQLLESGGGLVQPGGSLRLSCAASGFTFGRFAMSWVRQAPGKGLEWVSGITGSGTSTYYADSVKGRFTISRDNSKNTLYLQMNSLRAEDTAVYYCARDDRVRFSPVRRWFDPWGQGTLVTVSS

SEQ ID NO: 622 - protein, 119 aa, synthetic construct
EVQLLESGGGLVQPGGSLRLSCAASGFTFSKYAMGWVRQAPGKGLEWVSAISATGGSTYYADSVKGRFTISRDNSKNTLYLQMNSLRAEDTAVYYCARVRSSSWYGDYWGQGTLVTVSS

SEQ ID NO: 623 - protein, 119 aa, synthetic construct
EVQLLESGGGLVQPGGSLRLSCAASGFTFSRYAMTWVRQAPGKGLEWVSTISGSGVTTYYADSVKGRFTISRDNSKNTLYLQMNSLRAEDTAVYYCARKTGGHYPFDYWGQGTLVTVSS

SEQ ID NO: 624 - protein, 119 aa, synthetic construct
EVQLLESGGGLVQPGGSLRLSCAASGFTFSRSAMSWVRQAPGKGLEWVSSISASGANTYYADSVKGRFTISRDNSKNTLYLQMNSLRAEDTAVYYCARDQARYYGMDVRGQGTLVTVSS

SEQ ID NO: 625 - protein, 119 aa, synthetic construct
EVQLLESGGGLVQPGGSLRLSCAASGFTFRNYAMSWVRQAPGKGLEWVSTITSSGGSTYYADSVKGRFTISRDNSKNTLYLQMNSLRAEDTAVYYCASGLRARNGFDIWGQGTLVTVSS

SEQ ID NO: 626 - protein, 115 aa, synthetic construct
EVQLLESGGGLVQPGGSLRLSCAASGFTFSNYAMTWVRQAPGKGLEWVSGISGSGGSTYYADSVKGRFTISRDNSKNTLYLQMNSLRAEDTAVYYCARGAILAYWGQGTLVTVSS

SEQ ID NO: 627 - protein, 118 aa, synthetic construct
EVQLLESGGGLVQPGGSLRLSCAASGFTFSSYAMIWVRQAPGKGLEWVSAVSGTGGTTYYADSVKGRFTISRDNSKNTLYLQMNSLRAEDTAVYYCARDVGFGELHPWGQGTLVTVSS

SEQ ID NO: 628 - protein, 120 aa, synthetic construct
EVQLLESGGGLVQPGGSLRLSCAASGFTFSSYAMHWVRQAPGKGLEWVSGISGSGYSTYYADSVKGRFTISRDNSKNTLYLQMNSLRAEDTAVYYCARGRTGTLYGMDVWGQGTLVTVSS

SEQ ID NO: 629 - protein, 122 aa, synthetic construct
EVQLLESGGGLVQPGGSLRLSCAASGFSFNNYAMSWVRQAPGKGLEWVSAISGGGSNTYYADSVKGRFTISRDNSKNTLYLQMNSLRAEDTAVYYCARVAASGSYYRAFDQWGQGTLVTVSS

SEQ ID NO: 630 - protein, 118 aa, synthetic construct
EVQLLESGGGLVQPGGSLRLSCAASGFTFRRYAMSWVRQAPGKGLEWVSGISSSGGNTYYADSVKGRFTISRDNSKNTLYLQMNSLRAEDTAVYYCARDRGFGWFDPWGQGTLVTVSS

SEQ ID NO: 631 - protein, 124 aa, synthetic construct
EVQLLESGGGLVQPGGSLRLSCAASGFTFRSYGMTWVRQAPGKGLEWVSTISGSGGRTYYADSVKGRFTISRDNSKNTLYLQMNSLRAEDTAVYYCAKVSYDSSGYYYDAFDIWGQGTLVTVSS

SEQ ID NO: 632 - protein, 118 aa, synthetic construct
EVQLLESGGGLVQPGGSLRLSCAASGFTFANYAMSWVRQAPGKGLEWVSAISGSGGSAYYADSVKGRFTISRDNSKNTLYLQMNSLRAEDAAVYYCARSGSFLSFDSWGQGTLVTVSS

SEQ ID NO: 633 - protein, 123 aa, synthetic construct
EVQLLESGGGLVQPGGSLRLSCAASGFTFGRFAISWVRQAPGKGLEWVSTISGSGGRTYYADSVKGRFTISRDNSKNTLYLQMNSLRAEDTAVYYCARVDYKKKSYYNAMDAWGQGTLVTVSS

SEQ ID NO: 634 - protein, 119 aa, synthetic construct
EVQLLESGGGLVQPGGSLRLSCAASGFTFRTSAMSWVRQAPGKGLEWVSAISSGGGGTYYADSVKGRFTISRDNSKNTLYLQMNSLRAEDTAVYYCARGPRGRGAFDVWGQGTLVTVSS

SEQ ID NO: 635 - protein, 124 aa, synthetic construct
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDDRVRFSPVRRWFDPWGQGTLVTVSS

SEQ ID NO: 636 - protein, 121 aa, synthetic construct
EVQLLESGGGLVQPGGSLRLSCAASGIHLSSYAMSWVRQAPGKGLEWVSTISGGGGGTYYADSVKGRFTISRDNSKNTLYLQMNSLRAEDTAVYYCARGGHVGIRRPFDVWGQGTLVTVSS

SEQ ID NO: 637 - protein, 121 aa, synthetic construct
EVQLLESGGGLVQPGGSLRLSCAASGFTFSKYAMSWVRQAPGKGLEWVSIISGSGGTTYYADSVKGRFTISRDNSKNTLYLQMNSLRAEDTAVYYCARHAHGAGSYPFDYWGQGTLVTVSS

SEQ ID NO: 638 - protein, 119 aa, synthetic construct
EVQLLESGGGLVQPGGSLRLSCAASGFPFSSYAMGWVRQAPGKGLEWVSVISGSGGRTHYADSVKGRFTISRDNSKNTLYLQMNSLRAEDTAVYYCGRAPRKYYGMDVWGQGTLVTVSS

SEQ ID NO: 639 - protein, 122 aa, synthetic construct
EVQLLESGGGLVQPGGSLRLSCAASGFSFSAYAMSWVRQAPGKGLEWVSAISGRDTSTYYADSVKGRFTISRDNSKNTLYLQMNSLRAEDTAVYYCARVPLRGSGRLSFDYWGQGTLVTVSS

SEQ ID NO: 640 - protein, 124 aa, synthetic construct
EVQLLESGGGLVQPGGSLRLSCAASGSPFSNYAMSWVRQAPGKGLEWVSAISGSGGSTFYSDSVKGRFTISRDNSKNTLYLQMNSLRAEDTAVYYCARAPRSPILGVRRGLDPWGQGTLVTVSS

SEQ ID NO: 641 - protein, 117 aa, synthetic construct
EVQLLESGGGLVQPGGSLRLSCAASGFSFSGYAMNWVRQAPGKGLEWVSAISGSSGRTYYADSVKGRFTISRDNSKNTLYLQMNSLRAEDTAVYYCVRGGTRGLGYWGQGTLVTVSS

SEQ ID NO: 642 - protein, 123 aa, synthetic construct
EVQLLESGGGLVQPGGSLRLSCAASGFTFRTYGMSWVRQAPGKGLEWVSAISGSGETTYYADSVKGRFTISRDNSKNTLYLQMNSLRAEDTAVYYCARLDHDSSGFYEAFDVWGQGTLVTVSS

SEQ ID NO: 643 - protein, 125 aa, synthetic construct
EVQLLESGGGLVQPGGSLRLSCAASGLTFSRYAMSWVRQAPGKGLEWVSSISGRGGNTYYADSVKGRFTISRDNSKNTLYLQMNSLRAEDTAVYYCARGGMRLGKSYYYYGMDVWGQGTLVTVSS

SEQ ID NO: 644 - protein, 121 aa, synthetic construct
EVQLLESGGGLVQPGGSLRLSCAASGFAFSTSAMSWVRQAPGKGLEWVSGISASGGSTHYADSVKGRFTISRDNSKNTLYLQMNSLRAEDTAVYYCARLSVARGAYGMDVWGQGTLVTVSS

SEQ ID NO: 645 - protein, 120 aa, synthetic construct
EVQLLESGGGLVQPGGSLRLSCAASGFTFGAYAMSWVRQAPGKGLEWVSAISGSGARTYYADSVKGRFTISRDNSKNTLYLQMNSLRAEDTAVYYCARRGRPPQYYFDSWGQGTLVTVSS

SEQ ID NO: 646 - protein, 118 aa, synthetic construct
EVQLLESGGGLVQPGGSLRLSCAASGFTFRRYAMSWVRQAPGKGLEWVSTVSGSGGTTYYADSVKGRFTISRDNSKNTLYLQMNSLRAEDTAVYYCARGWEPGIAANWGQGTLVTVSS

SEQ ID NO: 647 - protein, 120 aa, synthetic construct
EVQLLESGGGLVQPGGSLRLSCAASGFTFSKHAMSWVRQAPGKGLEWVSIISGSGDTTYYADSVKGRFTISRDNSKNTLYLQMNSLRAEDTAVYYCARHQYSGSGSFRYWGQGTLVTVSS

SEQ ID NO: 648 - protein, 118 aa, synthetic construct
EVQLLESGGGLVQPGGSLRLSCAASGFTFRRSAMSWVRQAPGKGLEWVSAIGGSGDNTYYADSVKGRFTISRDNSKNTLYLQMNSLRAEDTAVYYCAKHRGSFWFDPWGQGTLVTVSS

SEQ ID NO: 649 - protein, 122 aa, synthetic construct
EVQLLESGGGLVQPGGSLRLSCAASGFSFRSYAMNWVRQAPGKGLEWVSAISGSGGNTFYADSVKGRFTISRDNSKNTLYLQMNSLRAEDTAVYYCTTMFGSGTFYTGFDFWGQGTLVTVSS

SEQ ID NO: 650 - protein, 119 aa, synthetic construct
EVQLLESGGGLVQPGGSLRLSCAASGFTFSSSSMSWIRQAPGKGLEWVSGISGSGGTTYYADSVKGRFTISRDNSKNTLYLQMNSLRAEDTAVYYCARAGARFVGFDYWGQGTLVTVSS

SEQ ID NO: 651 - protein, 117 aa, synthetic construct
EVQLLESGGGLVQPGGSLRLSCAASGFTFSRFAMSWVRQAPGKGLEWVSAISGSGRNTYYADSVKGRFTISRDNSKNTLYLQMNSLRAEDTAVYYCATFNPVGLFYWGQGTLVTVSS

SEQ ID NO: 652 - protein, 118 aa, synthetic construct
EVQLLESGGGLVQPGGSLRLSCAASGFSFSTYAMMWVRQAPGKGLEWVSAISGSAVSTYYADSVKGRFTISRDNSKNTLYLQMNSLRAEDAAVYYCARSGSFLSFDSWGQGTLVTVSS

SEQ ID NO: 653 - protein, 118 aa, synthetic construct
EVQLLESGGGLVQPGGSLRLSCAASGFTFSRYTMNWVRQAPGKGLEWVSAVSGSGGRTYYADSVKGRFTISRDNSKNTLYLQMNSLRAEDTAVYYCARSRNGRWFDPWGQGTLVTVSS

SEQ ID NO: 654 - protein, 115 aa, synthetic construct
EVQLLESGGGLVQPGGSLRLSCAASGLTFRSYAMSWVRQAPGKGLEWVSGISGSGGSTYYADSVKGRFTISRDNSKNTLYLQMNSLRAEDTAVYYCARGASFDSWGQGTLVTVSS

SEQ ID NO: 655 - protein, 122 aa, synthetic construct
EVQLLESGGGLVQPGGSLRLSCAASGFTFSNYAMKWVRQAPGKGLEWVSGISGSGARTYYADSVKGRFTISRDNSKNTLYLQMNSLRAEDTAVYYCARGRQRQRSTPLGRYWGQGTLVTVSS

SEQ ID NO: 656 - protein, 117 aa, synthetic construct
EVQLLESGGGLVQPGGSLRLSCAASGFNFRDYAMSWVRQAPGKGLEWVSAISGRGSVYYADSVKGRFTISRDNSKNTLYLQMNSLRAEDTAVYYCARGGDWVAFDYWGQGTLVTVSS

SEQ ID NO: 657 - protein, 119 aa, synthetic construct
EVQLLESGGGLVQPGGSLRLSCAASGFTFSGYVMSWFRQAPGKGLEWVSGISGSGGRTYYADSVKGRFTISRDNSKNTLYLQMNSLRAEDTAVYYCARRKGPTYGMDVWGQGTLVTVSS

SEQ ID NO: 658 - protein, 122 aa, synthetic construct
EVQLLESGGGLVQPGGSLRLSCAASGFTFSTFAMAWVRQAPGKGLEWVSALSGSGGRTYYADSVKGRFTISRDNSKNTLYLQMNSLRAEDTAVYYCARVTRYQGWLSHFDYWGQGTLVTVSS

SEQ ID NO: 659 - protein, 122 aa, synthetic construct
EVQLLESGGGLVQPGGSLRLSCAASGFTLSTYAMSWVRQAPGKGLEWVSTISTSGGSTYYADSVKGRFTISRDNSKNTLYLQMNSLRAEDTAVYYCARVFVSSGWYDGMDVWGQGTLVTVSS

SEQ ID NO: 660 - protein, 115 aa, synthetic construct
EVQLLESGGGLVQPGGSLRLSCAASGLTFNNYAMSWVRQAPGKGLEWVSGISGSGARTYYADSVKGRFTISRDNSKNTLYLQMNSLRAEDTAVYYCARGASLDVWGQGTLVTVSS

SEQ ID NO: 661 - protein, 117 aa, synthetic construct
EVQLLESGGGLVQPGGSLRLSCAASGFTFGRYAMSWVRQAPGKGLEWVSTISGSGTTTYYADSVKGRFTISRDNSKNTLYLQMNSLRAEDTAVYYCARAIGGRTAYWGQGTLVTVSS

SEQ ID NO: 662 - protein, 122 aa, synthetic construct; identical to SEQ ID NO: 639

SEQ ID NO: 663 - protein, 122 aa, synthetic construct
EVQLLESGGGLVQPGGSLRLSCAASGFTFGRYAMNWVRQAPGKGLEWVSTITASGGSTYYADSVKGRFTISRDNSKNTLYLQMNSLRAEDTAVYYCARVVTAMGYYYGMDVWGQGTLVTVSS

SEQ ID NO: 664 - protein, 125 aa, synthetic construct
EVQLLESGGGLVQPGGSLRLSCAASGFTFSNYGVSWVRQAPGKGLEWVSAISAGGGNTYYADSVKGRFTISRDNSKNTLYLQMNSLRAEDTAVYYCARDLGMRGPYYYYYGMDVWGQGTLVTVSS

SEQ ID NO: 665 - protein, 117 aa, synthetic construct
EVQLLESGGGLVQPGGSLRLSCAASGFTFSYYGMSWVRQAPGKGLEWVSAISGGGAGTYYADSVKGRFTISRDNSKNTLYLQMNSLRAEDTAVYYCVASRNYLLDFWGQGTLVTVSS

SEQ ID NO: 666 - protein, 120 aa, synthetic construct
EVQLLESGGGLVQPGGSLRLSCAASGFTFTKYAMSWVRQAPGKGLEWVGAISGRGGSTYYADSVKGRFTISRDNSKNTLYLQMNSLRAEDTAVYYCARGDLTVTRKYDSWGQGTLVTVSS

SEQ ID NO: 667 - protein, 118 aa, synthetic construct
EVQLLESGGGLVQPGGSLRLSCAASGFTFRSYGMTWVRQAPGKGLEWVSAISRSGGNTYYADSVKGRFTISRDNSKNTLYLQMNSLRAEDTAVYYCARTYSYGSFDYWGQGTLVTVSS

SEQ ID NO: 668 - protein, 117 aa, synthetic construct
EVQLLESGGGLVQPGGSLRLSCAASGFNFRSYAMNWVRQAPGKGLEWVSAISGSGTTTYYADSVKGRFTISRDNSKNTLYLQMNSLRAEDTAVYYCASWRAAPFDYWGQGTLVTVSS

SEQ ID NO: 669 - protein, 122 aa, synthetic construct; identical to SEQ ID NO: 639

SEQ ID NO: 670 - protein, 116 aa, synthetic construct
EVQLLESGGGLVQPGGSLRLSCAASGFTFGNYAMTWVRQAPGKGLEWVSSITGSGGSTYYADSVKGRFTISRDNSKNTLYLQMNSLRAEDTAVYYCAKGKFHLDPWGQGTLVTVSS

SEQ ID NO: 671 - protein, 117 aa, synthetic construct
EVQLLESGGGLVQPGGSLRLSCAASGFSFSSYAMSWVRQAPGKGLEWVGAISGRGGSTYYADSVKGRFTISRDNSKNTLYLQMNSLRAEDTAVYYCTTDYGAIMDVWGQGTLVTVSS

SEQ ID NO: 672 - protein, 119 aa, synthetic construct
EVQLLESGGGLVQPGGSLRLSCAASGFTFGRFAMSWVRQAPGKGLEWVSGISGSGTSTYYADSVKGRFTISRDNSKNTLYLQMNSLRAEDTAVYYCARDSRNYFGMGVWGQGTLVTVSS

SEQ ID NO: 673 - protein, 119 aa, synthetic construct
EVQLLESGGGLVQPGGSLRLSCAASGFTFGNYALSWVRQAPGKGLEWVSAISRSGGNTYYADSVKGRFTISRDNSKNTLYLQMNSLRAEDTAVYYCGRDGTRFGAFDIWGQGTLVTVSS

SEQ ID NO: 674 - protein, 116 aa, synthetic construct
EVQLLESGGGLVQPGGSLRLSCAASGFTFNKFAMTWVRQAPGKGLEWVSTISGSGSRTYYADSVKGRFTISRDNSKNTLYLQMNSLRAEDTAVYYCARGRSWYNHWGQGTLVTVSS

SEQ ID NO: 675 - protein, 120 aa, synthetic construct
EVQLLESGGGLVQHGGSLRLSCAASGLTFSSYALSWVRQAPGKGLEWVSDISGSGGNTYYADSVKGRFTISRDNSKNTLYLQMNSLRAEDTAVYYCARFQPRPLRLFDYWGQGTLVTVSS

SEQ ID NO: 676 - protein, 121 aa, synthetic construct
EVQLLESGGGLVQPGGSLRLSCAASGFTLRSYAMTWVRQAPGKGLEWVSAISGSGGYTYYADSVKGRFTISRDNSKNTLYLQMNSLRAEDTAVYYCARASYGSGSYPLIHWGQGTLVTVSS

SEQ ID NO: 677 - protein, 118 aa, synthetic construct
EVQLLESGGGLVQPGGSLRLSCAASGFTFSSFAMSWVRQAPGKGLEWVSTVSGSGGSTYYADSVKGRFTISRDNSKNTLYLQMNSLRAEDTAVYYCAGHRSNIGWDVWGQGTLVTVSS

SEQ ID NO: 678 - protein, 124 aa, synthetic construct
EVQLLESGGGLVQPGGSLRLSCAASGSTFSSYAMSWVRQAPGKGLEWVSTISASGGRTYYADSVKGRFTISRDNSKNTLYLQMNSLRAEDTAVYYCARDDRVRFSPVRRWFDPWGQGTLVTVSS

SEQ ID NO: 679 - protein, 118 aa, synthetic construct
EVQLLESGGGLVQPGGSLRLSCAASGFTFRRSAMSWVRQAPGKGLEWVSAISGSGSGTYYADSVKGRFTISRDNSKNTLYLQMNSLRAEDTAVYYCARSARGRWFDPWGQGTLVTVSS

SEQ ID NO: 680 - protein, 124 aa, synthetic construct
EVQLLESGGGLVQPGGSLRLSCAASGFTFAGYAMSWVRQALGKGLEWVSAISRSGDRTYYADSVKGRFTISRDNSKNTLYLQMNSLRAEDTAVYYCAKGQRAHQQLVRGAMDVWGQGTLVTVSS

SEQ ID NO: 681 - protein, 121 aa, synthetic construct
EVQLLESGGGLVQPGGSLRLSCAASGFTFRTFAMSWVRQAPGKGLEWVSGISASGGTTYYADSVKGRFTISRDNSKNTLYLQMNSLRAEDTAVYYCAHRRRSKFWSGFGVWGQGTLVTVSS

SEQ ID NO: 682 - protein, 119 aa, synthetic construct; identical to SEQ ID NO: 623

SEQ ID NO: 683 - protein, 118 aa, synthetic construct
EVQLLESGGGLVQPGGSLRLSCAASGFTFDNYAMTWVRQAPGKGLEWVSGISGSGGSIYYADSVKGRFTISRDNSKNTLYLQMNSLRAEDTAVYYCVKGAPAGYLDSWGQGTLVTVSS

SEQ ID NO: 684 - protein, 119 aa, synthetic construct
EVQLLESGGGLVQPGGSLRLSCAASGFRFSSYAMSWVRQAPGKGLEWVSTISGRGGSTDYADSVKGRFTISRDNSKNTLYLQMNSLRAEDTAVYYCARHNRERRAFDIWGQGTLVTVSS

SEQ ID NO: 685 - protein, 126 aa, synthetic construct
EVQLLESGGGLVQPGGSLRLSCAASGFTFRSYAMGWVRQAPGKGLEWVSGISGGGGTTYYADSVKGRFTISRDNSKNTLYLQMNSLRAEDTAVYYCARDSRVRGTHDYYYYGMDVWGQGTLVTVSS

SEQ ID NO: 686 - protein, 116 aa, synthetic construct
EVQLLESGGGLVQPGGSLRLSCAASGFTFSKFAMNWVRQAPGKGLEWVSGISASGGRTYYADSVKGRFTISRDNSKNTLYLQMNSLRAEDTAVYYCARGSLRFTPWGQGTLVTVSS

SEQ ID NO: 687 - protein, 120 aa, synthetic construct
EVQLLESGGGLVQPGGSLRLSCAASGFTFSSSGMSWVRQAPGKGLEWVSAISPSGGSTYYADSVKGRFTISRDNSKNTLYLQMNSLRAEDTAVYYCARLSADRVFAFDIWGQGTLVTVSS

SEQ ID NO: 688 - protein, 118 aa, synthetic construct
EVQLLESGGGLVQPGGSLRLSCAASGFSFSSFAMAWVRQAPGKGLEWVSTISGSGDVTYYADSVKGRFTISRDNSKNTLYLQMNSLRAEDTAVYYCAGHRSNIGWDVWGQGTLVTVSS

SEQ ID NO: 689 - protein, 122 aa, synthetic construct
EVQLLESGGGLVQPGGSLRLSCAASGFTFGRFAMSWVRQAPGKGLEWVSGITGSGTSTYYADSVKGRFTISRDNSKNTLYLQMNSLRAEDTAVYYCARVPLRGSGRLSFDYWGQGTLVTVSS

SEQ ID NO: 690 - protein, 123 aa, synthetic construct
EVQLLESGGGLVQPGGSLRLSCAASGFGFSSYAMSWVRQAPGKGLEWVSGITGSGGNTYYADSVKGRFTISRDNSKNTLYLQMNSLRAEDTAVYYCAKSRRPRYSYGFAFESWGQGTLVTVSS

SEQ ID NO: 691 - protein, 118 aa, synthetic construct
EVQLLESGGGLVQPGGSLRLSCAASGVTFRNYAMSWVRQAPGKGLEWVSAISASGGSPYYADSVKGRFTISRDNSKNTLYLQMNSLRAEDTAVYYCARDTSVGWFDPWGQGTLVTVSS

SEQ ID NO: 692 - protein, 119 aa, synthetic construct
EVQLLESGGGLVQPGGSLRLSCAASGFTFRNYAMSWVRQAPGKGLEWVSSISGGGGRTYYADSVKGRFTISRDNSKNTLYLQMNSLRAEDTAVYYCVRDLTRRAAMDVWGQGTLVTVSS

SEQ ID NO: 693 - protein, 121 aa, synthetic construct
EVQLLESGGGLVQPGGSLRLSCAASGFTFRSSAMSWVRQAPGKGLEWVSVISGSGRSTYYADSVKGRFTISRDNSKNTLYLQMNSLRAEDTAVYYCARNGAGSHYYAMDVWGQGTLVTVSS

SEQ ID NO: 694 - protein, 119 aa, synthetic construct
EVQLLESGGGLVQPGGSLRLSCAASGFTFSRFAMGWVRQAPGKGLEWVSSISGSGGRTYYADSVKGRFTISRDNSKNTLYLQMNSLRAEDTAVYYCASSKVTRSALDYWGQGTLVTVSS

SEQ ID NO: 695 - protein, 117 aa, synthetic construct
EVQLLESGGGLVQPGGSLRLSCAASGFTFGNYALSWVRQAPGKGLEWVSAISGSGSSTFYADSVKGRFTISRDNSKNTLYLQMNSLRAEDTAVYYCGRESGRGSGTWGQGTLVTVSS

SEQ ID NO: 696 - protein, 122 aa, synthetic construct
EVQLLESGGGLVQPGGSLRLSCAASGFTYSSYAMTWVRQAPGKGLEWVSVISGSGGSTYHADSVKGRFTISRDNSKNTLYLQMNSLRAEDTAVYYCARERELYYFYYGMDVWGQGTLVTVSS

SEQ ID NO: 697 - protein, 119 aa, synthetic construct
EVQLLESGGGLVQPGGSLRLSCAASGFTFSTYGMGWVRQAPGKGLEWVSTITGSGGSTYYADSVKGRFTISRDNSKNTLYLQMNSLRAEDTAVYYCARHHNRRSSLDYWGQGTLVTVSS

SEQ ID NO: 698 - protein, 123 aa, synthetic construct
EVQLLESGGGLVQPGGSLRLSCAASGFTFSSSGMSWVRQAPGKGLEWVSGISSTGGTTYYADSVKGRFTISRDNSKNTLYLQMNSLRAEDTAVYYCARRGRRQLRYYYGMDVWGQGTLVTVSS

SEQ ID NO: 699 - protein, 117 aa, synthetic construct
EVQLLESGGGLVQPGGSLRLSCAASGFSFSSSAMNWVRQAPGKGLEWVAAISGSGGTTYYADSVKGRFTISRDNSKNTLYLQMNSLRAEDTAVYYCARARRRSFDWWGQGTLVTVSS

SEQ ID NO: 700 - protein, 118 aa, synthetic construct
EVQLLESGGDLVQPGGSLRLSCAASGFTFSRYAMSWVRQAPGKGLEWVSAISGGRVSTYYADSVKGRFTISRDNSKNTLYLQMNSLRAEDTAVYYCARSLRGNAFDIWGQGTLVTVSS

SEQ ID NO: 701 - protein, 116 aa, synthetic construct
EVQLLESGGGLVQPGGSLRLSCAASGFTFSGYAMSWVRQAPGKGLEWVSSIRGSGGSTYYADSVKGRFTISRDNSKNTLYLQMNSLRAEDTAVYYCAKDLQSRGYWGQGTLVTVSS

SEQ ID NO: 702 - protein, 118 aa, synthetic construct
EVQLLESGGGLVQPGGSLRLSCAASGFTFNKFAMSWVRQAPGKGLEWVSGISVSGGNTYYADSVKGRFTISRDNSKNTLYLQMNSLRAEDTAVYYCARHSRLAALLAWGQGTLVTVSS

SEQ ID NO: 703 - protein, 118 aa, synthetic construct
EVQLLESGGGLVQPGGSLRLSCAASGFTFSSHVMGWVRQAPGKGMEWVSGISGSGAGTYYADSVKGRFTISRDNSKNTLYLQMNSLRAEDTAVYYCAVTGTTGWFDPWGQGTLVTVSS

SEQ ID NO: 704 - protein, 119 aa, synthetic construct
EVQLLESGGGLVQPGGSLRLSCAASGFTFGRYAMSWVRQAPGKGLEWVSGISSSRGSTYYADSVKGRFTISRDNSKNTLYLQMNSLRAEDTAVYYCARVGIAGRGMDVWGQGTLVTVSS

SEQ ID NO: 705 - protein, 118 aa, synthetic construct
EVQLLESGGGLVQPGGSLRLSCAASGFTFNTYGMSWVRQAPGKGLEWVSAISGRRTYYADSVKGRFTISRDNSKNTLYLQMNSLRAEDTAVYYCARVSRGYPRRSDSWGQGTLVTVSS

SEQ ID NO: 706 - protein, 117 aa, synthetic construct
EVQLLESGGGLVQPGGSLRLSCAASGFTVSSYAMSWVRQAPGKGLEWVSGISGGGGTTYYADSVKGRFTISRDNSKNTLYLQMNSLRAEDTAVYYCVRSSNWKFDQWGQGTLVTVSS

SEQ ID NO: 707 - protein, 119 aa, synthetic construct; identical to SEQ ID NO: 624

SEQ ID NO: 708 - protein, 115 aa, synthetic construct
EVQLLESGGGLVQPGGSLRLSCAASGFTFRSYDMTWVRQAPGKGLEWVSSISGSGVTTYYADSVKGRFTISRDNSKNTLYLQMNSLRAEDTAVYYCARGRRLDYWGQGTLVTVSS

SEQ ID NO: 709 - protein, 118 aa, synthetic construct
EVQLLESGGGLVQPGGSLRLSCAASGFAFTTYAMGWVRQAPGKGLEWVSAISGSGSTTYYADSVKSRFTISRDNSKNTLYLQMNSLRAEDTAVYYCARSGSFLSFDSWGQGTLVTVSS

SEQ ID NO: 710 - protein, 119 aa, synthetic construct
EVQLLESGGGLVQPGGSLRLSCAASGFTFSSYDMIWVRQAPRKGLEWVSAISGSGRNTYYADSVKGRFTISRDNSKNTLYLQMNSLRAEDTTVYYCARGGGASNWFDPWGQGTLVTISS

SEQ ID NO: 711 - protein, 122 aa, synthetic construct; identical to SEQ ID NO: 639

SEQ ID NO: 712 - protein, 113 aa, synthetic construct
EVQLLESGGGLVQPGGSLRLSCAASGFTFSRFAMSWVRQAPGKGLEWVSSISGTGSSTYYADSVKGRFTISRDNSKNTLYLQMNSLRAEDTAVYYCARVPGNWGQGTLVTVSS

SEQ ID NO: 713 - protein, 108 aa, synthetic construct
DIQMTQSPSSLSASVGDRVTITCSGDKLRNKYASWYQQKPGKAPKLLIYGASTLQSGVPSRFSGSGSGTDFTLTISSLQPEDFATYYCQSYDDHDRIVFGQGTKVEIK

SEQ ID NO: 714 - protein, 106 aa, synthetic construct
DIQMTQSPSSLSASVGDRVTITCRASQPIGPDLLWYQQKPGKAPKLLIYSASVLQSGVPSRFSGSGSGTDFTLTISSLQPEDFATYYCQQSYSTPTFGQGTKVEIK

SEQ ID NO: 715 - protein, 107 aa, synthetic construct
DIQMTQSPSSLSASVGDRVTITCRASQSISSYVNWYQQKPGKAPKLVIYGRNKRPSGVPSRFSGSGSGTDFTLTISSLQPEDFATYYCQQSYSSPLTFGQGTKVEIK

SEQ ID NO: 716 - protein, 107 aa, synthetic construct
DIQMTQSPSSLSASVGDRVTITCRTSQDISNYLNWYQQKPGKAPKLLIYAASDLESGVPSRFSGSGSGTDFTLTISSLQPEDFATYYCQQYYNLPWTFGQGTKVEIK

SEQ ID NO: 717 - protein, 108 aa, synthetic construct
DIQMTQSPSSLSASVGDRVTITCRASQDIYQNLDWYQQKPGKAPKLLIYAASGLPSGVPSRFSGSGSGTDFTLTISSLQPEDFATYYCASRDRSGHGVFGQGTKVEIK

SEQ ID NO: 718 - protein, 107 aa, synthetic construct
DIQMTQSPSSLSASVGDRVTITCRASQPIGPDLLWYQQKPGKAPKLLIYGASSRATGVPSRFSGSGSGTDFTLTISSLQPEDFATYYCQQSYNTPLTFGQGTKVEIK

SEQ ID NO: 719 - protein, 107 aa, synthetic construct
DIQMTQSPSSLSASVGDRVTITCRASQSIRRYLNWYQQKPGKAPKLLIYGRNKRPSGVPSRFSGSGSGTDFTLTISSLQPEDFATYYCQHSYRSGRAFGQGTKVEIK

SEQ ID NO: 720 - protein, 106 aa, synthetic construct
DIQMTQSPSSLSASVGDRVTITCRASQDVSSGVAWYQQKPGKAPKLLIYDASSLHTGVPSRFSGSGSGTDFTLTISSLQPEDFATYYCKQSYTLRTFGQGTKVEIK

SEQ ID NO: 721 - protein, 107 aa, synthetic construct
DIQMTQSPSSLSASVGDRVTITCRPSQRISRYLNWYQQKPGKAPKLLIYGKKNRPSGVPSRFSGSGSGTDFTLTISSLQPEDFATYYCQQSYSPPLTFGQGTKVEIK

SEQ ID NO: 722 - protein, 107 aa, synthetic construct
DIQMTQSPSSLSASVGDRVTITCRASQTIGDYLNWYQQKPGKAPKLLIYHTSRLHSGVPSRFSGSGSGTDFTLTISSLQPEDFATYYCGQDYTSPRTFGQGTKVEIK

SEQ ID NO: 723 - protein, 103 aa, synthetic construct
DIQMTQSPSSLSASVGDRVTITCRASQTIERRLNWYQQKPGKAPKLLIYQDFKRPSGVPSRFSGSGSGTDFTLTISSLQPEDFATYYCQQSRTFGQGTKVEIK

SEQ ID NO: 724 - protein, 106 aa, synthetic construct
DIQMTQSPSSLSASVGDRVTITCRASQSIRRYLNWYQQKPGKAPKLLIYGKKNRPSGVPSRFSGSGSGTDFTLTISSLQPEDFATYYCQQSYSTPSFGQGTKVEIK

SEQ ID NO: 725 - protein, 109 aa, synthetic construct
DIQMTQSPSSLSASVGDRVTITCRASQTIERRLNWYQQKPGKAPKLLIYGNNNRPSGVPSRFSGSGSGTDFTLTISSLQPEDFATYYCSSWAGSRSGTVFGQGTKVEIK

SEQ ID NO: 726 - protein, 110 aa, synthetic construct
DIQMTQSPSSLSASVGDRVTITCRASQNIRSYLNWYQQKPGKAPKLLIYATSNLASGVPSRFSGSGSGTDFTLTISSLQPEDFATYYCNSRDTSINHPVIFGQGTKVEIK

SEQ ID NO: 727 - protein, 106 aa, synthetic construct
DIQMTQSPSSLSASVGDRVTITCSASQDINKYLNWYQQKPGKAPKLLIYDNTNRPSGVPSRFSGSGSGTDFTLTISSLQPEDFATYYCQQSYSTPTFGQGTKVEIK

SEQ ID NO: 728 - protein, 109 aa, synthetic construct
DIQMTQSPSSLSASVGDRVTITCSGDRLGEKYVSWYQQKPGKAPKLLIYDNTNRPSGVPSRFSGSGSGTDFTLTISSLQPEDFATYYCLAWDTRTSGAVFGQGTKVEIK

SEQ ID NO: 729 - protein, 109 aa, synthetic construct
DIQMTQSPSSLSASVGDRVTITCRASQSISSYVNWYQQKPGKAPKLLIYAKNNRPSGVPSRFSGSGSGTDFTLTISSLQPEDFATYYCQSYGSHSNFVVFGQGTKVEIK

SEQ ID NO: 730 - protein, 108 aa, synthetic construct
DIQMTQSPSSLSASVGDRVTITCRASQTIGDYLNWYQQKPGKAPKLLIYAASSLYSGVPSRFSGSGSGTDFTLTISSLQPEDFATYYCQSYDLRYSHVFGQGTKLEIK

SEQ ID NO: 731 - protein, 110 aa, synthetic construct
DIQMTQSPSSLSASVGDRVTITCRASQDIKNYLNWYQQKPGKAPKLLIYGTSYRYSGVPSRFSGSGSGTDFTLTISSLQPEDFATYYCASRSSKGNPHVLFGQGTKVEIK

SEQ ID NO: 732 - protein, 107 aa, synthetic construct
DIQMTQSPSSLSASVGDRVTITCRASQNIRSYLNWYQQKPGKAPKLLIYGKNIRPSGVPSRFSGSGSGTDFTLTISSLQPEDFATYYCQQRARHPHTFGQGTKVEIK

SEQ ID NO: 733 - protein, 108 aa, synthetic construct
DIQMTQSPSSLSASVGDRVTITCSGDNLRSYYVHWYQQKPGKAPKLLIYQDFKRPSGVPSRFSGSGSGTDFTLTISSLQPEDFATYYCQSYDDHDRIVFGQGTKVEIK

SEQ ID NO: 734 - protein, 109 aa, synthetic construct
DIQMTQSPSSLSASVGDRVTITCTGDKLAEKYVSWYQQKPGKAPKLLIYDNNIRPSGVPSRFSGSGSGTDFTLTISSLQPEDFATYYCLAWDTRTSGAVFGQGTKVEIK

SEQ ID NO: 735 - protein, 106 aa, synthetic construct
DIQMTQSPSSLSASVGDRVTITCRASSSVSYMHWYQQKPGKAPKLLIYAASTLQRGVPSRFSGSGSGTDFTLTISSLQPEDFATYYCQQGKTLPLTFGQGTKVEIK

SEQ ID NO: 736 - protein, 107 aa, synthetic construct
DIQMTQSPSSLSASVGDRVTITCRASQSISSYVNWYQQKPGKAPKLLIYAVTSLASGVPSRFSGSGSGTDFTLTISSLQPEDFATYYCQQSTILPLTFGQGTKVEIK

SEQ ID NO: 737 - protein, 107 aa, synthetic construct
DIQMTQSPSSLSASVGDRVTITCRASQSIRRYLNWYQQKPGKAPKLLIYGRNKRPSGVPSRFSGSGSGTDFTLTISSLQPEDFATYYCQQRARHPHTFGQGTKVEIK

SEQ ID NO: 738 - protein, 107 aa, synthetic construct
DIQMTQSPSSLSASVGDRVTITCRASQTIERRLNWYQQKPGKAPKLLIYDDIDRPSGVPSRFSGSGSGTDFTLTISSLQPEDFATYYCQQGSSLPLTFGQGTKVEIK

SEQ ID NO: 739 - protein, 106 aa, synthetic construct
DIQMTQSPSSLSASVGDRVTITCSGGSGSYGWYQQKPGKAPKLLIYGNNNRPSGVPSRFSGSGSGTDFTLTISSLQPEDFATYYCNSRDTSGNHRVFGQGTKVEIK

SEQ ID NO: 740 - protein, 109 aa, synthetic construct
DIQMTQSPSSLSASVGDRVTITCRTSQDISNYLNWYQQKPGKAPKLLIYQNDKRPSGVPSRFSGSGSGTDFTLTISSLQPEDFATYYCNSRDTSGNHLVFGQGTKVEIK

SEQ ID NO: 741 - protein, 106 aa, synthetic construct
DIQMTQSPSSLSASVGDRVTITCRASQDIYQNLDWYQQKPGKAPKLLIYQNDKRPSGVPSRFSGSGSGTDFTLTISSLQPEDFATYYCQQTYSTRTFGQGTKVEIK

SEQ ID NO: 742 - protein, 107 aa, synthetic construct
DIQMTQSPSSLSASVGDRVTITCRASQSISSYVNWYQQKPGKAPKLLIYGRNKRPSGVPSRFSGSGSGTDFTLTISSLQPEDFATYYCQAWGSSTVIFGQGTKVEIK

SEQ ID NO: 743 - protein, 107 aa, synthetic construct
DIQMTQSPSSLSASVGDRVTITCRASQSIRRYLNWYQQKPGKAPKLLIYRKSNRPSGVPSRFSGSGSGTDFTLTISSLQPEDFATYYCQQRARHPHTFGQGTKVEIK

SEQ ID NO: 744 - protein, 116 aa, synthetic construct
DIQMTQSPSSLSASVGDRVTITCTSSQSLFNVRSQKNYLAWYQQKPGKAPKLLIYDTSKVASGVPSRFSGSGSGTDFTLTISSLQPEDFATYYCSSRDNSDNHLVVFGQGTKVEIK

SEQ ID NO: 745 - protein, 107 aa, synthetic construct
DIQMTQSPSSLSASVGDRVTITCRASQSIRRYLNWYQQKPGKAPKLLIYGKNIRPSGVPSRFSGSGSGTDFTLTISSLQPEDFATYYCQQSYSAPLTFGQGTKVEIK

SEQ ID NO: 746 - protein, 107 aa, synthetic construct
DIQMTQSPSSLSASVGDRVTITCTGDKLAEKYVSWYQQKPGKAPKLLIYHTSRLQSGVPSRFSGSGSGTDFTLTISSLQPEDFATYYCQVWDTGTVVFGQGTKVEIK

SEQ ID NO: 747 - protein, 106 aa, synthetic construct
DIQMTQSPSSLSASVGDRVTITCSASQDINKYLNWYQQKPGKAPKLLIYDNNNRPSGVPSRFSGSGSGTDFTLTISSLQPEDFATYYCQQSYSTPTFGQGTKVEIK

SEQ ID NO: 748 - protein, 110 aa, synthetic construct
DIQMTQSPSSLSASVGDRVTITCRASQPIAYFLSWYQQKPGKAPKLLIYGKNIRPSGVPSRFSGSGSGTDFTLTISSLQPEDFATYYCASRSSKGNPHVLFGQGTKVEIK

SEQ ID NO: 749 - protein, 107 aa, synthetic construct
DIQMTQSPSSLSASVGDRVTITCKASDHIGKFLTWYQQKPGKAPKLLIYAASTLQRGVPSRFSGSGSGTDFTLTISSLQPEDFATYYCQQSYETPLTFGQGTKVEIK

SEQ ID NO: 750 - protein, 107 aa, synthetic construct
DIQMTQSPSSLSASVGDRVTITCRASQSISSYVNWYQQKPGKAPKLLIYAVTSLASGVPSRFSGSGSGTDFTLTISSLQPEDFATYYCQQSTIMPLTFGQGTKVEIK

SEQ ID NO: 751 - protein, 106 aa, synthetic construct
DIQMTQSPSSLSASVGDRVTITCRASQSIRRYLNWYQQKPGKAPKLLIYRKSNRPSGVPSRFSGSGSGTDFTLTISSLQPEDFATYYCQQSYSTPTFGQGTKVEIK

SEQ ID NO: 752 - protein, 107 aa, synthetic construct
DIQMTQSPSSLSASVGDRVTITCQASQSISSYLAWYQQKPGKAPKLLIYQNDKRPSGVPSRFSGSGSGTDFTLTISSLQPEDFATYYCQQRDTTPWTFGQGTKVEIK

SEQ ID NO: 753 - protein, 108 aa, synthetic construct
DIQMTQSPSSLSASVGDRVTITCRASQDIKNYYKWYQQKPGKAPKLLIYENNNRPSGVPSRFSGSGSGTDFTLTISSLQPEDFATYYCQARDRNTYVAFGQGTKVEIK

SEQ ID NO: 754 - protein, 109 aa, synthetic construct
DIQMTQSPSSLSASVGDRVTITCRASQYIGTALNWYQQKPGKAPKLLIYDNNIRPSGVPSRFSGSGSGTDFTLTISSLQPEDFATYYCNSRDTSGLHYVFGQGTKVEIK

SEQ ID NO: 755 - protein, 107 aa, synthetic construct
DIQMTQSPSSLSASVGDRVTITCRASQSISGYLNWYQQKPGKAPKLLIYGQHNRPSGVPSRFSGSGSGTDFTLTISSLQPEDFATYYCQQYDAYPPTFGQGTKVEIK

SEQ ID NO: 756 - protein, 107 aa, synthetic construct
DIQMTQSPSSLSASVGDRVTITCRASQSIGRYMNWYQQKPGKAPKLLIYGKNIRPSGVPSRFSGSGSGTDFTLTISSLQPEDFATYYCQQSYSAPLTFGQGTKVEIK

SEQ ID NO: 757 - protein, 107 aa, synthetic construct
DIQMTQSPSSLSASVGDRVTITCRASQDIYQNLDWYQQKPGKAPKLLIYEDTKRPSGVPSRFSGSGSGTDFTLTISSLQPEDFATYYCLQYASSPFTFGQGTKVEIK

SEQ ID NO: 758 - protein, 106 aa, synthetic construct
DIQMTQSPSSLSASVGDRVTITCRASQPIGPDLLWYQQKPGKALKLLIYAVTSLASGVPSRFSGSGFGTDFTLTISSLQPEDFATYYCQQSFSVPAFGQGTKVEIK

SEQ ID NO: 759 - protein, 107 aa, synthetic construct; identical to SEQ ID NO: 718

SEQ ID NO: 760 - protein, 106 aa, synthetic construct
DIQMTQSPSSLSASVGDRVTITCSASQDINKYLNWYQQKPGKAHKLMIYDNNNRPSGVPSRFSGSGCGTDFTLTISSLQPEDFATYYCQQSYSTPTFGQGTKVEIK

SEQ ID NO: 761 - protein, 107 aa, synthetic construct
DIQMTQSPSSLSASVGDRVTITCRASQRISSFLNWYQQKPGKAPKLLIYRKSNRPSGVPSRFSGSGSGTDFTLTISSLQPEDFATYYCSQSTRVPPTFGQGTKVEIK

SEQ ID NO: 762 - protein, 109 aa, synthetic construct
DIQMTQSPSSLSASVGDRVTITCRPNQNIATYINWYQQKPGKAPKLLIYHTSRLQSGVPSRFSGSGSGTDFTLTISSLQPEDFATYYCSSWAGSRSGTVFGQGTKVEIK

SEQ ID NO: 763 - protein, 106 aa, synthetic construct
DIQMTQSPSSLSASVGDRVTITCSGDLRNKYASWYQQKPGKAPKLLIYGQHNRPSGVPSRFSGSGSGTDFTLTISSLQPEDFATYYCSSGSRSGTVFGQGTKVEIK

SEQ ID NO: 764 - protein, 107 aa, synthetic construct
DIQMTQSPSSLSASVGDRVTITCRASQPIGPDLLWYQQKPGKAPKLLIYANTNGPSGVPSRFSGSGSGTDFTLTISSLQPEDFATYYCQQSYSAPYTFGQGTKVEIK

SEQ ID NO: 765 - protein, 107 aa, synthetic construct
DIQMTQSPSSLSASVGDRVTITCQASQSIYSFLSWYQQKPGKAPKLLIYRKSNRPSGVPSRFSGSGSGTDFTLTISSLQPEDFATYYCQQTATWPFTFGQGTKVEIK

SEQ ID NO: 766 - protein, 106 aa, synthetic construct; identical to SEQ ID NO: 727

SEQ ID NO: 767 - protein, 107 aa, synthetic construct
DIQMTQSPSSLSASVGDRVTITCKASDHIGKFLTWYQQKPGKAPKLLIYHTSRLHSGVPSRFSGSGSGTDFTLTISSLQPEDFATYYCQQSYKYPLTFGQGTKVEIK

SEQ ID NO: 768 - protein, 107 aa, synthetic construct
DIQMTQSPSSLSASVGDRVTITCRASHNINSYLNWYQQKPGKAPKLLIYQDFKRPSGVPSRFSGSGSGTDFTLTISSLQPEDFATYYCQQSYSSPLTFGQGTKVEIK

SEQ ID NO: 769 - protein, 106 aa, synthetic construct; identical to SEQ ID NO: 727

SEQ ID NO: 770 - protein, 107 aa, synthetic construct
DIQMTQSPSSLSASVGDRVTITCRTSQDISNYLNWYQQKPGKAPKLLIYGTSYRYSGVPSRFSGSGSGTDFTLTISSLQPEDFATYYCQQGYTLPWTFGQGTKVEIK

SEQ ID NO: 771 - protein, 107 aa, synthetic construct
DIQMTQSPSSLSASVGDRVTITCRANQNIGNFLNWYQQKPGKAPKLLIYHTSRLHSGVPSRFSGSGSGTDFTLTISSLQPEDFATYYCQQSYSAPLTFGQGTKVEIK

SEQ ID NO: 772 - protein, 106 aa, synthetic construct
DIQMTQSPSSLSASVGDRVTITCSASSSVTYMHWYQQKPGKAPKLLIYHDNKRPSGVPSRFSGSGSGTDFTLTISSLQPEDFATYYCQQSYDNPLTFGQGTKVEIK

SEQ ID NO: 773 - protein, 107 aa, synthetic construct
DIQMTQSPSSLSASVGDRVTITCRASQDIYQNLDWYQQKPGKAPKLLIYQNDKRPSGVPSRFSGSGSGTDFTLTISSLQPEDFATYYCLQFDHTPFTFGQGTKVEIK

SEQ ID NO: 774 - protein, 107 aa, synthetic construct
DIQMTQSPSSLSASVGDRVTITCRTSQDIGNYLNWYQQKPGKAPKLLIYHTSRLHSGVPSRFSGSGSGTDFTLTISSLQPEDFATYYCQQGYRFPLTFGQGTKVEIK

SEQ ID NO: 775 - protein, 110 aa, synthetic construct; identical to SEQ ID NO: 748

SEQ ID NO: 776 - protein, 106 aa, synthetic construct
DIQMTQSPSSLSASVGDRVTITCSGDNLRGYYASWYQQKPGKAPKLLIYQDFKRPSGVPSRFSGSGSGTDFTLTISSLQPEDFATYYCQQSYSPLTFGQGTKVEIK

SEQ ID NO: 777 - protein, 110 aa, synthetic construct
DIQMTQSPSSLSASVGDRVTITCRSSQLVHSTGNTYLHWYQQKPGKAPKLLIYGASSRATGVPSRFSGSGSGTDFTLTISSLQPEDFATYYCSQSTHVPTFGQGTKVEIK

SEQ ID NO: 778 - protein, 110 aa, synthetic construct
DIQMTQSPSSLSASVGDRVTITCQGASLRNYYASWYQQKPGKAPKLLIYENNNRPSGVPSRFSGSGSGTDFTLTISSLQPEDFATYYCSTRSRKGNPHVLFGQGTKVEIK

SEQ ID NO: 779 - protein, 107 aa, synthetic construct
DIQMTQSPSSLSASVGDRVTITCRASQDIKNYLNWYQQKPGKAPKLLIYQASSLQSGVPSRFSGSGSGTDFTLTISSLQPEDFATYYCQQSYSPPLTFGQGTKVEIK

SEQ ID NO: 780 - protein, 107 aa, synthetic construct
DIQMTQSPSSLSASVGDRVTITCRASQDVSSGVAWYQQKPGKAPKLLIYDDIDRPSGVPSRFSGSGSGTDFTLTISSLQPEDFATYYCHQRSSYPWTFGQGTKVEIK

SEQ ID NO: 781 - protein, 107 aa, synthetic construct
DIQMTQSPSSLSASVGDRVTITCRASQGVRTSLAWYQQKPGKAPKLLIYSASVLQSGVPSRFSGSGSGTDFTLTISSLQPEDFATYYCQAWDNSAVIFGQGTKVEIK

SEQ ID NO: 782 - protein, 106 aa, synthetic construct; identical to SEQ ID NO: 727

SEQ ID NO: 783 - protein, 107 aa, synthetic construct
DIQMTQSPSSLSASVGDRVTITCTGDKLAEKNVSWYQQKPGKAPKLLIYQNDKRPSGVPSRFSGSGSGTDFTLTISSLQPEDFATYYCQQTYSTPLTFGQGTKVEIK

SEQ ID NO: 784 - protein, 107 aa, synthetic construct
DIQMTQSPSSLSASVGDRVTITCRASQTIGDYLNWYQQKPGKAPKLLIYAASGLQSGVPSRFSGSGSGTDFTLTISSLQPEDFATYYCQQSNSWPYTFGQGTKVEIK

SEQ ID NO: 785 - protein, 107 aa, synthetic construct
DIQMTQSPSSLSASVGDRVTITCRASQSISSYVNWYQQKPGKAPKLLIYLSSDLQSGVPSRFSGSGSGTDFTLTISSLQPEDFATYYCAQTGTHPTTFGQGTKVEIK

SEQ ID NO: 786 - protein, 112 aa, synthetic construct
DIQMTQSPSSLSASVGDRVTITCRTSQSLSSYLHWYQQKPGKAPKLLIYEDTKRPSGVPSRFSGSGSGTDFTLTISSLQPEDFATYYCHTWHHNPHTGETNHFGQGTKVEIK

SEQ ID NO: 787 - protein, 106 aa, synthetic construct; identical to SEQ ID NO: 727

SEQ ID NO: 788 - protein, 109 aa, synthetic construct
DIQMTQSPSSLSASVGDRVTITCRASQDVSSGVAWYQQKPGKAPKLLIYGASRLQRGVPSRFSGSGSGTDFTLTISSLQPEDFATYYCNSRDTSGLHYVFGQGTKVEIK

SEQ ID NO: 789 - protein, 107 aa, synthetic construct
DIQMTQSPSSLSASVGDRVTITCRASQTIERRLNWYQQKPGKAPKLLIYENNNRPSGVPSRFSGSGSGTDFTLTISSLQPEDFATYYCQQTYSPPLTFGQGTKVEIK

SEQ ID NO: 790 - protein, 107 aa, synthetic construct
DIQMTQSPSSLSASVGDRVTITCSASQDINKYLNWYQQKPGKAPKLLIYGASSRATGVPSRFSGSGSGTDFTLTISSLQPEDFATYYCQQSYSSPLTFGQGTKVEIK

SEQ ID NO: 791 - protein, 107 aa, synthetic construct
DIQMTQSPSSLSASVGDRVTITCRATQSIRSFLNWYQQKPGKAPKLLIYGQHNRPSGVPSRFSGSGSGIDFTLTISSLQPEDFATYYCQQYYDWPLTFGQGTKVEIK

SEQ ID NO: 792 - protein, 106 aa, synthetic construct
DIQMTQSPSSLSASVGDRVTITCRASQDIYQNLDWYQQKPGKAPKLLIYGKNIRPSGVPSRFSGSGSGTDFTLTISSLQPEDFATYYCQQYYSGWTFGQGTKVEIK

SEQ ID NO: 793 - protein, 107 aa, synthetic construct
DIQMTQSPSSLSASVGDRVTITCRTSQSLSSYLHWYQQKPGKAPKLLIYGRNKRPSGVPSRFSGSGSGTDFTLTISSLQPEDFATYYCQNVLSTPYTFGQGTKVEIK

SEQ ID NO: 794 - protein, 106 aa, synthetic construct
DIQMTQSPSSLSASVGDRVTITCSGDLRNKYASWYQQKPGKAPKLLIYGTSNLESGVPSRFSGSGSGTDFTLTISSLQPEDFATYYCQAWVSSTVVFGQGTKVEIK

SEQ ID NO: 795 - protein, 107 aa, synthetic construct
DIQMTQSPSSLSASVGDRVTITCRASQSVDRYFNWYQQKPGKAPKLLIYSASFLYSGVPSRFSGSGSGTDFTLTISSLQPEDFATYYCSQSTHVPLTFGQGTKVEIK

SEQ ID NO: 796 - protein, 106 aa, synthetic construct
DIQMTQSPSSLSASVGDRVTITCRASQFIGRYFNWYQQKPGKAPKLLIYGRNKRPSGVPSRFSGSGSGTDFTLTISSLQPEDFATYYCQQSYSTPTFGQGTKVEIK

SEQ ID NO: 797 - protein, 107 aa, synthetic construct
DIQMTQSPSSLSASVGDRVTITCRASQPIGPDLLWYQQKPGKAPKLLIYGKKNRPSGVPSRFSGSGSGTDFTLTISSLQPEDFATYYCQQSYSTPRTFGQGTKVEIK

SEQ ID NO: 798 - protein, 106 aa, synthetic construct
DIQMTQSPSSLSASVGDRVTITCRASQTIGDYLNWYQQKPGKAPKLLIYGASRLQRGVPSRFSGSGSGTDFTLTISSLQPEDFATYYCSQSTHVPTFGQGTKVEIK

SEQ ID NO: 799 - protein, 107 aa, synthetic construct
DIQMTQSPSSLSASVGDRVTITCRASQTIERRLNWYQQKPGKAPKLLIYGQHNRPSGVPSRFSGSGSGTDFTLTISSLQPEDFATYYCQQYHSYPPTFGQGTKVEIK

SEQ ID NO: 800 - protein, 106 aa, synthetic construct
DIQMTQSPSSLSASVGDRVTITCRASQSIRRFLNWYQQKPGKAPKLLIYGASSRATGVPSRFSGSGSGTDFTLTISSLQPEDFATYYCQQSFSVPAFGQGTKVEIK

SEQ ID NO: 801 - protein, 107 aa, synthetic construct
DIQMTQSPSSLSASVGDRVTITCRASQDIYQNLDWYQQKPGKAPKLLIYGNNNRPSGVPSRFSGSGSGTDFTLTISSLQPEDFATYYCQQSYSAPLTFGQGTKVEIK

SEQ ID NO: 802 - protein, 107 aa, synthetic construct
DIQMTQSPSSLSASVGDRVTITCRPNQNIATYINWYQQKPGKAPKLLIYHDNKRPSGVPSRFSGSGSGTDFTLTISSLQPEDFATYYCLQDYNYPLTFGQGTKVEIK

SEQ ID NO: 803 - protein, 107 aa, synthetic construct
DIQMTQSPSSLSASVGDRVTITCSASQDINKYLNWYQQKPGKAPKLLIYGRNKRPSGVPSRFSGSGSGTDFTLTISSLQPEDFATYYCQQTYNVPPTFGQGTKVEIK

SEQ ID NO: 804 - protein, 108 aa, synthetic construct
DIQMTQSPSSLSASVGDRVTITCRANQNIGNFLNWYQQKPGKAPKLLIYNAKTLPEGVPSRFSGSGSGTDFTLTISSLQPEDFATYYCASRDRSGHGVFGQGTKVEIK

SEQ ID NO: 805 - protein, 109 aa, synthetic construct
DIQMTQSPSSLSASVGDRVTITCRASQTIERRLNWYQQKPGKAPKLLIYQNDKRPSGVPSRFSGSGSGTDFTLTISSLQPEDFATYYCSSRDRSGNHRVFGQGTKVEIK

SEQ ID NO: 806 - protein, 106 aa, synthetic construct
DIQMTQSPSSLSASVGDRVTITCRASQRISSFLNWYQQKPGKAPKLLIYQNDKRPSGVPSRFSGSGSGTDFTLTISSLQPEDFATYYCQQSYSTPTFGQGTKVEIK

SEQ ID NO: 807 - protein, 107 aa, synthetic construct
DIQMTQSPSSLSASVGDRVTITCRASQSISSYVNWYQQKPGKAPKLLIYHDNKRPSGVPSRFSGSGSGTDFTLTISSLQPEDFATYYCAQNLEIPRTFGQGTKVEIK

SEQ ID NO: 808 - protein, 107 aa, synthetic construct
DIQMTQSPSSLSASVGDRVTITCSGDKLGDKYAYWYQQKPGKAPKLLIYHDNKRPSGVPSRFSGSGSGTDFTLTISSLQPEDFATYYCQPSFYFPYTFGQGTKVEIK

SEQ ID NO: 809 - protein, 106 aa, synthetic construct; identical to SEQ ID NO: 792

SEQ ID NO: 810 - protein, 107 aa, synthetic construct
DIQMTQSPSSLSASVGDRVTITCQASQSISSYLAWYQQKPGKAPKLLIYGASTLQSGVPSRFSGSGSGTDFTLTISSLQPEDFATYYCQQYWAFPVTFGQGTKVEIK

SEQ ID NO: 811 - protein, 107 aa, synthetic construct
DIQMTQSPSSLSASVGDRVTITCRASQSISGYLNWYQQKPGKAPKLLIYAKNNRPSGVPSRFSGSGSGTDFTLTISSLQPEDFATYYCQQSYSSPRTFGQGTKVEIK

SEQ ID NO: 812 - protein, 107 aa, synthetic construct
DIQMTQSPSSLSASVGDRVTITCSASQDINKYLNWYQQKPGKAPKLLIYDTSKVASGVPSRFSGSGSGTDFTLTISSLQPEDFATYYCQQSYSTPNTFGQGTKVEIK

SEQ ID NO: 813 - protein, 106 aa, synthetic construct
DIQMTQSPSSLSASVGDRVTITCRASQNIRSYLNWYQQKPGKAPKLLIYDNNIRPSGVPSRFSGSGSGTDFTLTISSLQPEDFATYYCLQDYNLWTFGQGTKVEIK

SEQ ID NO: 814 - protein, 107 aa, synthetic construct
DIQMTQSPSSLSASVGDRVTITCRASQSIREYLHWYQQKPGKAPKLLIYATSNLASGVPSRFSGSGSGTDFTLTISSLQPEDFATYYCQAWDTSTAVFGQGTKVEIK

SEQ ID NO: 815 - protein, 106 aa, synthetic construct
DIQMTQSPSSLSASVGDRVTITCSGDLGEKYVSWYQQKPGKAPKLLIYATSTLQSGVPSRFSGSGSGTDFTLTISSLQPEDFATYYCQAWASSTVVFGQGTKVEIK

SEQ ID NO: 816 - protein, 110 aa, synthetic construct
DIQMTQSPSSLSASVGDRVTITCRPNQNIATYINWYQQKPGKAPKLLIYGNNNRPSGVPSRFSGSGSGTDFTLTISSLQPEDFATYYCSTRSSKGNPHVLFGQGTKVEIK

SEQ ID NO: 817 - protein, 110 aa, synthetic construct
DIQMTQSPSSLSASVGDRVTITCRASKVSTSGYVYMHWYQQKPGKAPKLLIYENNNRPSGVPSRFSGSGSGTDFTLTISSLQPEDFATYYCQQYWAFPVTFGQGTKVEIK

SEQ ID NO: 818 - protein, 106 aa, synthetic construct
DIQMTQSPSSLSASVGDRVTITCRASSSVSYMHWYQQKPGKAPKLLIYGENSRPSGVPSRFSGSGSGTDFTLTISSLQPEDFATYYCQQSYSTPWTFGQGTKVEIK

SEQ ID NO: 819 - protein, 106 aa, synthetic construct
DIQMTQSPSSLSASVGDRVTITCRASQDVSSGVAWYQQKPGKAPKLLIYGSSLQSGVPSRFSGSGSGTDFTLTISSLQPEDFATYYCQQYHSYPPTFGQGTKVEIK

SEQ ID NO: 820 - protein, 107 aa, synthetic construct
DIRMTQSPSSLSASVGDRVTITCRASQSVDRYFNWYQQKPGKAPKLLIYHTSRLHSGVPSRFSGSGSGTDFTLTISSLQPEDFATYYCQAWDNRAVVFGQGTKVEIK

SEQ ID NO: 821 - protein, 108 aa, synthetic construct
DIQMTQSPSSLSASVGDRVTITCQSSQSVYSNNELSWYQQKPGKAPKLLIYGNNNRPSGVPSRFSGSGSGTDFTLTISSLQPEDFATYYCQQSYSTPTFGQGTKVEIK

SEQ ID NO: 822 - protein, 107 aa, synthetic construct
DIQMTQSPSSLSASVGDRVTITCRSSQSISTYLNWYQQKPGKAPKLLIYAASRSQSGVPSRFSGSGSGTDFTLTISSLQPEDFATYYCQQNYIIPWTFGGGTKVEIK

SEQ ID NO: 823 - protein, 107 aa, synthetic construct
DIQMTQSPSSLSASVGDRVTITCRASHSISSYLNWYQQKPGKAPKLLIYTASRLRSGVPSRFSGSGSGTDFTLTISSLQPEDFATYYCQQNYNTPFTFGGGTKVEIK

SEQ ID NO: 824 - protein, 107 aa, synthetic construct
DIQMTQSPSSLSASVGDRVTITCRASQSIHSYLNWYQQKPGKAPKLLIYTASALQTGVPSRFSGSGSGTDFTLTISSLQPEDFATYYCQQSFSSPLTFGQGTKVEIK

SEQ ID NO: 825 - protein, 107 aa, synthetic construct
DIQMTQSPSSLSASVGDRVTITCRAGQSVSRFLNWYQQKPGKAPKLLIYAAATLQSGVPSRFSGSGSGTDFTLTISSLQPEDFATYYCQQSYDTPFTFGGGTKVEIK

SEQ ID NO: 826 - protein, 107 aa, synthetic construct
DIQMTQSPSSLSASVGDRVTITCRTSQSIGTYLNWYQQKPGKSPKLLIYDASILQSGVPSRFSGSGSGTDFTLTISSLQPEDFATYYCQQNYNTPLTFGGGTKVEIK

SEQ ID NO: 827 - protein, 108 aa, synthetic construct
DIQMTQSPSSLSASVGDRVTITCRASQSIGIHLNWYQQKPGKAPKLLIYGATSLESGVPSRFSGSGSGTDFTLTISSLQPEDFATYYCQQSYNTPPYTFGGGTKVEIK

SEQ ID NO: 828 - protein, 107 aa, synthetic construct
DIQMTQSPSSLSASVGDRVTITCRASQSIRSYLNWYQQKPGKAPKLLIYATSRLESGVPSRFSGSGSGTDFTLTISSLQPEDFATYYCQQGYTSPLTFGGGTKVEIK

SEQ ID NO: 829 - protein, 108 aa, synthetic construct
DIQMAQSPSSLSASVGDRVTITCRASQGIATYLNWYQQKPGKAPKLLIYGASTLRTGVPSRFSGSGSGTDFTLTISSLQPEDFATYYCQQTFTNTPLTFGGGTKVEIK

SEQ ID NO: 830 - protein, 107 aa, synthetic construct
DIQMTQSPSSLSASVGDRVTITCRASQSIGSYLNWYQQKPGKAPKLLIYAASSLKSGVPSRFSGSGSGTDFTLTISSLQPEDFATYYCQQSHNIPRTFGGGTKVEIK

SEQ ID NO: 831 - protein, 107 aa, synthetic construct
DIQMTQSPSSLSASVGDRVTITCRASQSISRNLNWYQQKPGKAPKLLIYGASRLHSGVPSRFSGSGSGTDFTLTISSLQPEDFATYYCQQGYITPQTFGGGTKVEIK

SEQ ID NO: 832 - protein, 107 aa, synthetic construct
DIQMTQSPSSLSASVGDRVTITCRASQSVRTYLNWYQQKPGKAPKLLIYRASRLQSGVPSRFSGSGSGTDFTLTISSLQPEDFATYYCQQSFTTPLTFGGGTKVEIK

SEQ ID NO: 833 - protein, 107 aa, synthetic construct
DIQMTQSPSSLSASVGDRVTITCRASQSIGSHLSWYQQKPGKAPKLLIYRASRLQSGVPSRFSGSGSGTDFTLTISSLQPEDFATYYCQQSYSPPITFGGGTKVEIK

SEQ ID NO: 834 - protein, 107 aa, synthetic construct
DIQMTQSPSSLSASVGDRVTITCRASQSISRYLNWYQQKPGKAPKLLIYGASKLQRGVPSRFSGSGSGTDFTLTISSLQPEDFATYYCQQSSSVPWTFGGGTKVEIK

SEQ ID NO: 835 - protein, 107 aa, synthetic construct
DIQMTQSPSSLSASVGDRVTITCRASQNIGNYLNWYQQKPGKAPKLLIYAASTLASGVPSRFSGSGSGTDFTLTISSLQPEDFATYYCQQNYNTPLTFGGGTKVEIK

SEQ ID NO: 836 - protein, 107 aa, synthetic construct
DIQMTQSPSSLSASVGDRVTITCRSSQSISTYLNWYQQKPGKAPKLLIYAASRLESGVPSRFSGSGSGTDFTLTISSLQPEDFATYYCQQSYTPPITFGGGTKVEIK

SEQ ID NO: 837 - protein, 107 aa, synthetic construct
DIQMTQSPSSLSASVGDRVTITCRASQNIGSYLNWYQQKPGKAPKLLIYAASKLHSGVPSRFSGSGSGTDFTLTISSLQPEDFATYYCQQSYNTPVTFGGGTKVEIK

SEQ ID NO: 838 - protein, 107 aa, synthetic construct
DIQMTQSPSSLSASVGDRVTITCRASQSISRFLNWYQQKPGKAPKLLIYGASALQTGVPSRFSGSGSGTDFTLTISSLQPEDFATYYCQQSYIPPLTFGGGTKVEIK

SEQ ID NO: 839 - protein, 107 aa, synthetic construct
DIQMTQSPSSLSASVGDRVTITCRASESITTYLNWYQQKPGKAPKLLIYTASSLQSGVPSRFSGSGSGTDFTLTISSLQPEDFATYYCQQNYITPLTFGGGTKVEIK

SEQ ID NO: 840 - protein, 106 aa, synthetic construct
DIQMTQSPSSLSASVGDRVTITCRASQSISTYLHWYQQKPGKAPKLLIYAASTLHSGVPSRFSGSGSGTDFTLTISSLQPEDFATYYCQQSYNSITFGGGTKVEIK

SEQ ID NO: 841 - protein, 107 aa, synthetic construct
DIQMTQSPSSLSASVGDRVTITCRSSQSIGSNLNWYQQKPGKAPKLLIYATSNLQSGVPSRFSGSGSGTDFTLTISSLQPEDFATYYCQQSYRIPRTFGGGTKVEIK

SEQ ID NO: 842 - protein, 107 aa, synthetic construct
DIQMTQSPSSLPASVGDRVTITCRASQSISRYLSWYQQKPGKAPKLLIYAASRLRSGVPSRFSGSGSGTDFTLTISSLQPEDFATYYCQQSYSTPTTFGGGTKVEIK

SEQ ID NO: 843 - protein, 106 aa, synthetic construct
DIQMTQSPSSLSASVGDRVTITCRASQYIGTYLNWYQQKPGKAPKLLIYAASNLQRGVPSRFSGSGSGTDFTLTISSLQPEDFATYYCQQSYSDLTFGGGTKVEIK

SEQ ID NO: 844 - protein, 108 aa, synthetic construct
DIQMTQSPSSLSASVGDRVTITCRASESISRNLNWYQQKPGKAPKLLIYAASSLRSGVPSRFSGSGSGTDFTLTISSLQPEDFATYYCQQSYSGPPYTFGGGTKVEIK

SEQ ID NO: 845 - protein, 107 aa, synthetic construct; identical to SEQ ID NO: 822

SEQ ID NO: 846 - protein, 107 aa, synthetic construct
DIQMTQSPSSLSASVGDRVTITCRASQSVSNFLNWYQQKPGKAPKLLIYGASNLHSGVPSRFSGSGSGTDFTLTISSLQPEDFATYYCQQSYSFPFSFGGGTKVEIK

SEQ ID NO: 847 - protein, 107 aa, synthetic construct
DIQMTQSPSSLSASVGDRVTITCRASRNIRTYLNWYQQKPGKAPKLLIYRASTLQSGVPSRFSGSGSGTDFTLTISSLQPEDFATYYCQQSYKTPVTFGGGTKVEIK

SEQ ID NO: 848 - protein, 107 aa, synthetic construct
DIQMTQSPSSLSASVGDRVTITCRASQSIGNFLNWYQQKPGKAPKLLIYRASRLQSGVPSRFSGSGSGTDFTLTISSLQPEDFATYYCQQSYNTPITFGGGTKVEIK

SEQ ID NO: 849 - protein, 108 aa, synthetic construct
DIQMTQSPSSLSASVGDRVTITCRASQSIRSYLNWYQQKPGKAPKLLIYGATNLQSGVPSRFSGSGSGTDFTLTISSLQPEDFATYYCQQSYSTLPFTFGGGTKVEIK

SEQ ID NO: 850 - protein, 103 aa, synthetic construct
DIQMTQSPSSLSASVGDRVTITCRASQSIRTYLNWYQQKPGKAPKLLIYGAVNLQSGVPSRFSGSGSGTDFTLTISSLQPEDFATYYCQQRDTFGGGTKVEIK

SEQ ID NO: 851 - protein, 107 aa, synthetic construct
DIQMTQSPSSLSASVGDRVTITCRASQNIYTYLNWYQQKPGKAPKPLIYLASSLQSGVPSRFSGSGSGTDFTLTISSLQPEDFATYYCQQSYSTRFTFGGGTKVEIK

SEQ ID NO: 852 - protein, 106 aa, synthetic construct
DIQMTQSPSSLSASVGDRVTITCRASQSISRYLSWYQQKPGKAPKLLIYGSSNLQSGVPSRFSGSGSGTDFTLTISSLQPEDFATYYCQQSYSSPTFGGGTKVEIK

SEQ ID NO: 853 - protein, 107 aa, synthetic construct
DIQMTQSPSSLSASVGDRVTITCRASQNIGRYLNWYQQKPGKAPKLLIYSASKLQSGVPSRFSGSGSGTDFTLTISSLQPEDFATYYCQQTYSPPLTFGGGTKVEIK

SEQ ID NO: 854 - protein, 106 aa, synthetic construct
DIQMTQSPSSLSASVGDRVTITCRASQTISAYLNWYQQKPGKAPKLLIYGASSVQSGVPSRFSGSGSGTDFTLTISSLQPEDFATYYCQQSYSGLTFGGGTKVEIK

SEQ ID NO: 855 - protein, 107 aa, synthetic construct
DIQMTQSPSSLSASVGDRVTITCRASQSIRGYLNWYQQKPGKAPKLLIYSTSSLQSGVPSRFSGSGSGTDFTLTISSLQPEDFATYYCQQNYNTPLTFGGGTKVEIK

SEQ ID NO: 856 - protein, 107 aa, synthetic construct
DIQMTQYPSSLSASVGDRVTITCRASQSVSYYLNWYQQKPGKAPKLLIYGSSNLQSGVPSRFSGSGSGTDFTLTISSLQPEDFATYYCQQTYSSPVTFGGGTKVEIK

SEQ ID NO: 857 - protein, 107 aa, synthetic construct
DIQMTQSPSSLSASVGDRVTITCRASQPISSYLNWYQQKPGKAPKLLIYSASSLRSGVPSRFSGSGSGTDFTLTISSLQPEDFATYYCQQGYSAPLTFGGGTKVEIK

SEQ ID NO: 858 - protein, 107 aa, synthetic construct
DIQMTQSPSSLSASVGDRVTITCQTSQSIGKYLNWYQQKPGKAPKLLIYGASRVQSGVPSRFSGSGSGTDFTLTISSLQPEDFATYYCQQTYSTPLTFGGGTKVEIK

SEQ ID NO: 859 - protein, 107 aa, synthetic construct
DIQMTQSPSSLSASVGDRVTITCRASQSIGAYLNWYQQKPGKAPKLLIYGTSSLQGGVPSRFSGSGSGTDFTLTISSLQPEDFATYYCQQSYGTLITFGGGTKVEIK

SEQ ID NO: 860 - protein, 107 aa, synthetic construct
DIQMTQSPSSLSASVGDRVTITCRASQTISTFLNWYQQKPGKAPKLLIYGASRLQGGVPSRFSGSGSGTDFTLTISSLQPEDFATYYCQQSYSTPLTFGGGTKVEIK

SEQ ID NO: 861 - protein, 106 aa, synthetic construct
DIQMTQSPSSLSASVGDRVTITCRASQSIGRYLNWYQQKPGKAPKLLIYAVSNLRSGVPSRFSGSGSGTDFTLTISSLQPEDFATYYCQQSYSTPSFGGGTKVEIK

SEQ ID NO: 862 - protein, 107 aa, synthetic construct
DIQMTQSPSSLSASVGDRVTITCRSSQSISNYLNWYQQKPGKAPKLLIYGASRLESGVPSRFSGSGSGTDFTLTISSLQPEDFATYYCQQSYSLPLTFGGGTKVEIK

SEQ ID NO: 863 - protein, 107 aa, synthetic construct
DIQMTQSPSSLSASVGDRVTITCRASQTISRSLNWYQQKPGKAPKLLIYGASRLQSGVPSRFSGSGSGTDFTLTISSLQPEDFATYYCQQSFTTPYTFGGGTKVEIK

SEQ ID NO: 864 - protein, 107 aa, synthetic construct
DIQMTQSPSSLSASVGDRVTITCRASQSISSYLDWYQQKPGKAPKLLIYAASRLQSGVPSRFSGSGSGTDFTLTISSLQPEDFATYYCQQNYRSPLTFGGGTKVEIK

SEQ ID NO: 865 - protein, 107 aa, synthetic construct
DIQMTQSPSSLSASVGDRVTITCRASRSIGTYLNWYQQKPGKAPKLLIYAASKLQSGVPSRFSGSGSGTDFTLTISSLQPEDFATYYCQQNYITPLTFGGGTKVEIK

SEQ ID NO: 866 - protein, 107 aa, synthetic construct
DIQMTQSPSSLSASVGDRVTITCRASQNINRYLNWYQQKPGKAPKLLIYASSRLQSGVPSRFSGSGSGTDFTLTISSLQPEDFATYYCQQSYSSPITFGGGTKVEIK

SEQ ID NO: 867 - protein, 107 aa, synthetic construct
DIQMTQSPSSLSASVGDRVTITCRASQSVSSYLSWYQQKPGKAPKLLIYATSNLQRGVPSRFSGSGSGTDFTLTISSLQPEDFATYYCHQTYSTPRTFGGGTKVEIK

SEQ ID NO: 868 - protein, 108 aa, synthetic construct; identical to SEQ ID NO: 827

SEQ ID NO: 869 - protein, 107 aa, synthetic construct
DIQMTQSPSSLSASVGDRVTITCRASRSISTYLNWYQQKPGKAPKLLIYEVSSLQSGVPSRFSGSGSGTDFTLTISSLQPEDFATYYCQQNYITPLTFGGGTKVEIK

SEQ ID NO: 870 - protein, 107 aa, synthetic construct
DIQMTQSPSSLSASVGDRVTITCRASQSISRYLSWYQQKPGKAPKLLIYAASRLQRGVPSRFSGSGSGTDFTLTISSLQPEDFATYYCQQGYSSPLTFGGGTKVEIK

SEQ ID NO: 871 - protein, 107 aa, synthetic construct
DIQMTQSPSSLSASVGDRVTITCRASQSISNFLSWYQQKPGKAPKLLIYGTSSLQGGVPSRFSGSGSGTDFTLTISSLQPEDFATYYCQQSYSIPFTFGGGTKVEIK

SEQ ID NO: 872 - protein, 108 aa, synthetic construct
DIQMTQSPSSLSASVGDRVTITCRASQGISFYLNWYQQKPGKAPKLLIYAASRLQRGVPSRFSGSGSGTDFTLTISSLQPEDFATYYCQQSYSTPQITFGGGTKVEIK

SEQ ID NO: 873 - protein, 107 aa, synthetic construct
DIQMTQSPSSLSASVGDRVTITCRASQNIKTYLNWYQQKPGKAPKLLIYGASSLESGVPSRFSGSGSGTDFTLTISSLQPEDFATYYCLQTYSVPLTFGGGTKVEIK

SEQ ID NO: 874 - protein, 107 aa, synthetic construct
DIQMTQSPSSLSASVGDRVTITCRASQYISNYLNWYQQKPGKAPKLLIYGASSIQNGVPSRFSGSGSGTDFTLTISSLQPEDFATYYCQQTYSLPLTFGGGTKVEIK

SEQ ID NO: 875 - protein, 107 aa, synthetic construct; identical to SEQ ID NO: 860

SEQ ID NO: 876 - protein, 107 aa, synthetic construct
DIQMTQSPSSLSASVGDRVTITCRASQSISRFLNWYQQKPGKAPKLLIYGASRLESGVPSRFSGSGSGTDFTLTISSLQPEDFATYYCQQSYKTPRTFGGGTKVEIK

SEQ ID NO: 877 - protein, 107 aa, synthetic construct
DIQMTQSPSSLSASVGDRVTITCRASESIDNYLNWYQQKPGKAPKLLIYGATSLESGVPSRFSGSGSGTDFTLTISSLQPEDFATYYCQQNYNIPFTFGGGTKVEIK

SEQ ID NO: 878 - protein, 107 aa, synthetic construct
DIQMTQSPSSLSASVGDRVTITCRTSQSISNFLNWYQQKPGKAPKLLIYTASKLQSGVPSRFSGSGSGTDFTLTISSLQPEDFATYYCQQSYRVPRTFGGGTKVEIK

SEQ ID NO: 879 - protein, 107 aa, synthetic construct
DIQMTQSPSSLSASVGDRVTITCRASQSIGTNLNWYQQKPGKAPKLLIYAASALQGGVPSRFSGSGSGTDFTLTISSLQPEDFATYYCQQSYSIPLTFGGGTKVEIK

SEQ ID NO: 880 - protein, 107 aa, synthetic construct
DIQMTQSPSSLSASVGDRVTITCRASQTITRYLNWYQQKPGKAPKLLIYAATSLHSGVPSRFSGSGSGTDFTLTISSLQPEDFATYYCQQSYSTPETFGGGTKVEIK

SEQ ID NO: 881 - protein, 107 aa, synthetic construct
DIQMTQSPSSLSASVGDRVTITCRASQSIGNFLNWYQQKPGKAPKLLIYDASSLQSGVPSRFSGSGSGTDFTLTISSLQPEDFATYYCQQSYSIPPTFGGGTKVEIK

SEQ ID NO: 882 - protein, 106 aa, synthetic construct
DIQMTQSPSSLSASVGDRVTITCRASHSISRYLNWYQQKPGKAPKLLIYGASNLPSGVPSRFSGSGSGTDFTLTISSLQPEDFATYYCQQSYSTHTFGGGTKVEIK

SEQ ID NO: 883 - protein, 107 aa, synthetic construct
DIQMTQSPSSLSASVGDRVTITCRASQGISFYLNWYQQKPGKAPKLLIYGASILQTGVPSRFSGSGSGTDFTLTISSLQPEDFATYYCQQSYSPPLTFGGGTKVEIK

SEQ ID NO: 884 - protein, 107 aa, synthetic construct
DIQMTQSPSSLSASVGDRVTITCRASQSVSNYLNWYQQKPGKAPKLLIYGASTLQAGVPSRFSGSGSGTDFTLTISSLQPEDFATYYCQQSYVTPPTFGGGTKVEIK

SEQ ID NO: 885 - protein, 107 aa, synthetic construct
DIQMTQSPSSLSASVGDRVTITCRASQSIGSFLNWYQQKPGKAPKLLIYAAFRLQSGVPSRFSGSGSGTDFTLTISSLQPEDFATYYCQQTYSPPFTFGGGTKVEIK

SEQ ID NO: 886 - protein, 107 aa, synthetic construct
DIQMTQSPSSLSASVGDRVTITCRASQSITRHLNWYQQKPGKAPKLLIYAASRLQTGVPSRFSGSGSGTDFTLTISSLQPEDFATYYCQQSYSTPGTFGGGTKVEIK

SEQ ID NO: 887 - protein, 107 aa, synthetic construct
DIQMTQSPSSLSASVGDRVTITCRASQRISRYLNWYQQKPGKAPKLLIYGASNLQGGVPSRFSGSGSGTDFTLTISSLQPEDFATYYCQQSYRTPITFGGGTKVEIK

SEQ ID NO: 888 - protein, 107 aa, synthetic construct
DIQMTQSPSSLSASVGDRVTITCRASQYIGNYLNWYQQKPGKAPKLLIYAVSRLQSGVPSRFSGSGSGTDFTLTISSLQPEDFATYYCQQSFSAPYTFGGGTKVEIK

SEQ ID NO: 889 - protein, 106 aa, synthetic construct
DIQMTQSPSSLSASVGDRVTITCRASQYISTFLNWYQQKPGKAPKLLIYSASRLQNGVPSRFSGSGSGTDFTLTISSLQPEDFATYYCQQSYSPLTFGGGTKVEIK

SEQ ID NO: 890 - protein, 107 aa, synthetic construct
DIQMTQSPSSLSASVGDRVTITCRASRSISRYLNWYQQKPGKAPKLLIYGASILQTGVPSRFSGSGSGTDFTLTISSLQPEDFATYYCQQSYTPPRTFGGGTKVETK

SEQ ID NO: 891 - protein, 107 aa, synthetic construct
DIQMTQSPSSLSASVGDRVTITCRASQSISRSLNWYQQKPGKAPKLLIYGASSLRSGVPSRFSGSGSGTDFTLTISSLQPEDFATYYCQQSFTIPWTFGGGTKVEIK

SEQ ID NO: 892 - protein, 107 aa, synthetic construct
DIQMTQSPSSLSASAGDRVTITCRASQSITSYLNWYQQKPGKAPKLLIYAASRLRSGVPSRFSGSGSGTDFTLTISSLQPEDFATYYCQQSYNTPVTFGGGTKVEIK

SEQ ID NO: 893 - protein, 107 aa, synthetic construct
DIQMTQSPSSLSASVGDRVTITCRASQNIAGYLNWYQQKPGKAPKLLIYAASRLHSGVPSRFSGSGSGTDFTLTISSLQPEDFATYYCQQSSSTPITFGGGTKVEIK

SEQ ID NO: 894 - protein, 107 aa, synthetic construct
DIQMTQSPSSLSASVGDRVTITCRASQTIRTYLNWYQQKPGKAPKLLIYATSSLQTGVPSRFSGSGSGTDFTLTISSLQPEDFATYYCQQSYRPPLTFGGGTKVEIK

SEQ ID NO: 895 - protein, 108 aa, synthetic construct; identical to SEQ ID NO: 827

SEQ ID NO: 896 - protein, 107 aa, synthetic construct
DIQMTQSPSSLSASVGDRVTITCRSSQSISTYLHWYQQKPGKAPKLLIYGASKLQSGVPSRFSGSGSGTDFTLTISSLQPEDFATYYCQQTYSAPRTFGGGTKVEIK

SEQ ID NO: 897 - protein, 107 aa, synthetic construct
DIQMTQSPSSLSASVGDRVTITCRASQSIGRYLNWYQQKPGKAPKLLIYGASRLQSGVPSRFSGSGSGTDFTLTISSLQPEDFATYYCQQSYRTPLTFGGGTKVEIK

SEQ ID NO: 898 - protein, 107 aa, synthetic construct
DIQMTQSPSSLSASVGDRVTITCRASHTISRYLNWYQQKPGKAPRLLIYAASDLQTGVPSRFSGGGSGTDFTLTISSLQPEDFATYYCQQSFTAPDTFGGGTKVEIK

SEQ ID NO: 899 - protein, 106 aa, synthetic construct
DIQMTQSPSSLSASVGDRVTITCRTSQSISRYLNWYQQKPGKAPKLLIYTTSDLQSGVPSRFSGSGSGTDFTLTISSLQPEDFATYYCQQSYSDLTFGGGTKVEIK

SEQ ID NO: 900 - protein, 107 aa, synthetic construct
DIQMTQSPSSLSASVGDRVTITCRASQRINTYLNWYQQKPGKAPKLLIYGAFRLQSGVPSRFSGSGSGTDFTLTISSLQPEDFATYYCQQSYRVPRTFGGGTKVEIK

SEQ ID NO: 901 - protein, 107 aa, synthetic construct
DIQMTQSPSSLSASVGDRVTITCRASQSINHYLNWYQQKPGKAPKLLIYGASRLQSGVPSRFSGSGSGTDFTLTISSLQPEDFATYYCQQSYSLPRTFGGGTKVEIK

SEQ ID NO: 902 - protein, 107 aa, synthetic construct
DIQMTQSPSSLSASVGDRVTITCRASQTIGRYLNWYQQKPGKAPKLLIYATSSLRSGVPSRFSGSGSGTDFTLTISSLQPEDFATYYCQQTYSTPYTFGGGTKVEIK

SEQ ID NO: 903 - protein, 107 aa, synthetic construct
DIQMTQSPSSLSASVGDRVTITCRASQSIGEYLNWYQQKPGKAPKLLIYAASRLQRGVPSRFSGSGSGTDFTLTISSLQPEDFATYYCQQNYRSPLTFGGGTKVEIK

SEQ ID NO: 904 - protein, 107 aa, synthetic construct
DIQMTQSPSSLSASVGDRVTITCRASQSIYRYLNWYQQKPGKAPKLLIYAATTLQSGVPSRFSGSGSGTDFTLTISSLQPEDFATYYCQQSYSPPLTFGGGTKVEIK

SEQ ID NO: 905 - protein, 107 aa, synthetic construct
DIQMTQSPSSLSASVGDRVTITCRASQNIGRYLNWYQQKPGKAPKLLIYEVSSLRSGVPSRFSGSGSGTDFTLTISSLQPEDFATYYCQQSYRTPGTFGGGTKVEIK

SEQ ID NO: 906 - protein, 107 aa, synthetic construct
DIQMTQSPSSLSASVGDRVTITCRAGQSIRNYLNWYQQKPGKAPKLLIYAATTLQSGVPSRFSGSGSGTDFTLTISSLQPEDFATYYCQQSFLTPWTFGGGTKVEIK

SEQ ID NO: 907 - protein, 107 aa, synthetic construct
DIQMTQSPSSLSASVGDRVTITCRASQSISRHLNWYQQKPGKAPKLLIYGATRLQSGVPSRFSGSGSGTDFTLTISSLQPEDFATYYCQQSYSKPYTFGGGTKVEIK

SEQ ID NO: 908 - protein, 107 aa, synthetic construct
DIQMTQSPSSLSASVGDRVTITCRASQSISRYLHWYQQKPGKAPKLLIYAATSLQSGVPSRFSGSGSGTDFTLTISSLQPEDFATYYCQQSYSTPLSFGGGTKVEIK

SEQ ID NO: 909 - protein, 107 aa, synthetic construct
DIQMTQSPSSLSASVGDRVTITCRTSQSIGTYLNWYQQKPGKAPKLLIYDTSNLQGGVPSRFSGSGSGTDFTLAISSLQPEDFATYYCQQSFTSPLTFGGGTKVEIK

SEQ ID NO: 910 - protein, 107 aa, synthetic construct
DIQMTQSPSSLSASVGDRVTITCRASQGIATYLNWYQQKPGKAPKLLIYAASSLQRGVPSRFSGSGSGTDFTLTISSLQPEDFATYYCQQTHSTPLTFGGGTKVEIK

SEQ ID NO: 911 - protein, 108 aa, synthetic construct
DIQMTQSPSSLSASVGDRVTITCRASQNIGGYLNWYQQKPGKAPKLLIYRASRLQSGVPSRFSGSGSGTDFTLTISSLQPEDFATYYCQQSYSTPLLTFGGGTKVEIK

SEQ ID NO: 912 - protein, 107 aa, synthetic construct
DIQMTQSPSSLSASVGDRVTITCRASQYIGNYLNWYQQKPGKAPKLLIYASSTLQRGVPSRFSGSGSGTDFTLTISSLQPEDFATYYCQQTSSTPLTFGGGTKVEIK

SEQ ID NO: 913 - protein, 107 aa, synthetic construct; identical to SEQ ID NO: 826

SEQ ID NO: 914 - protein, 107 aa, synthetic construct
DIQMTQSPSSLSASVGDRVTITCQASQNIGRYLNWYQQKPGKAPKLLIYAASALQGGVPSRFSGSGSGTDFTLTISSLQPEDFATYYCQQSYTPPRTFGGGTKVEIK

SEQ ID NO: 915 - protein, 107 aa, synthetic construct
DIQMTQSPSSLSASVGDRVTITCRASQSISRHLNWYQQKPGKAPKLLIYGASSLQSGVPSRFSGSGSGTDFTLTISSLQPEDFATYYCQQTYRTPLTFGGGTKVEIK

SEQ ID NO: 916 - protein, 107 aa, synthetic construct
DIQMTQSPSSLSASVGDRVTITCRASQSIHNYLNWYQQKPGKAPKLLIYAASSLHDGVPSRFSGSGSGTDFTLTISSLQPEDFATYYCQQSYSTPYTFGGGTKVEIK

SEQ ID NO: 917 - protein, 108 aa, synthetic construct
DIQMAQSPSSLSASVGDRVTITCRASQGIATYLNWYQQKPGKAPKFLIYGASTLRTGVPSRFSGSGSGTDFTLTISSLQPEDFATYYCQQTFTNTPLTFGGGTKVEIK

SEQ ID NO: 918 - protein, 107 aa, synthetic construct
DIQMTQSPSSLSASVGDRVTITCRASQTITKYLNWYQQKPGKAPKLLIYATSNLQTGVPSRFSGSGSGTDFTLTISSLQPEDFATYYCQQSYSAPVTFGGGTKVEIK

SEQ ID NO: 919 - protein, 7 aa, synthetic construct
GRTFSNF

SEQ ID NO: 920 - protein, 7 aa, synthetic construct
GNIDRLY

SEQ ID NO: 921 - protein, 10 aa, synthetic construct
GFTFSSFGNF

SEQ ID NO: 922 - protein, 7 aa, synthetic construct
GSIENIN

SEQ ID NO: 923 - protein, 7 aa, synthetic construct
GRIFGGY

SEQ ID NO: 924 - protein, 7 aa, synthetic construct
GRTFSRY

SEQ ID NO: 925 - protein, 7 aa, synthetic construct
GFGFGSY

SEQ ID NO: 926 - protein, 7 aa, synthetic construct
GFTVSSY

SEQ ID NO: 927 - protein, 7 aa, synthetic construct
GRTFRSY

SEQ ID NO: 928 - protein, 7 aa, synthetic construct
GFTSDDY

SEQ ID NO: 929 - protein, 7 aa, synthetic construct
GLTFSTY

SEQ ID NO: 930 - protein, 7 aa, synthetic construct
GRTFSGY

SEQ ID NO: 931 - protein, 7 aa, synthetic construct
GRTFINY

SEQ ID NO: 932 - protein, 7 aa, synthetic construct
GITFKRY

SEQ ID NO: 933 - protein, 7 aa, synthetic construct
GRTFTNY

SEQ ID NO: 934 - protein, 7 aa, synthetic construct
GSTSSLR

SEQ ID NO: 935 - protein, 7 aa, synthetic construct
GRTFSNT

SEQ ID NO: 936 - protein, 7 aa, synthetic construct
GIAFQGY

SEQ ID NO: 937 - protein, 7 aa, synthetic construct
GFLMYDR

SEQ ID NO: 938 - protein, 9 aa, synthetic construct
SIGIAFSSR

SEQ ID NO: 939 - protein, 7 aa, synthetic construct
GFTFSSS

SEQ ID NO: 940 - protein, 7 aa, synthetic construct
GRTFNSR

SEQ ID NO: 941 - protein, 7 aa, synthetic construct
GIPFSTR

SEQ ID NO: 942 - protein, 7 aa, synthetic construct
GPTVDAY

SEQ ID NO: 943 - protein, 7 aa, synthetic construct
GIPFSSR

SEQ ID NO: 944 - protein, 7 aa, synthetic construct
GRTFSSK

SEQ ID NO: 945 - protein, 7 aa, synthetic construct
GGIYRVN

SEQ ID NO: 946 - protein, 7 aa, synthetic construct
GRTISNA

SEQ ID NO: 947 - protein, 7 aa, synthetic construct
GTSFSIG

SEQ ID NO: 948 - protein, 7 aa, synthetic construct
GRTFSSY

SEQ ID NO: 949 - protein, 7 aa, synthetic construct
GRTFSNY

SEQ ID NO: 950 - protein, 7 aa, synthetic construct
GRTFRSY

SEQ ID NO: 951 - protein, 7 aa, synthetic construct
GRTFSSY

SEQ ID NO: 952 - protein, 7 aa, synthetic construct
GRTFSRF

SEQ ID NO: 953 - protein, 7 aa, synthetic construct
GRTSSAY

SEQ ID NO: 954 - protein, 7 aa, synthetic construct
GFRMYDR

SEQ ID NO: 955 - protein, 7 aa, synthetic construct
GRTFSYN

SEQ ID NO: 956 - protein, 7 aa, synthetic construct
GRTFSSN

SEQ ID NO: 957 - protein, 7 aa, synthetic construct
GRAFSSS

SEQ ID NO: 958 - protein, 7 aa, synthetic construct
GFTVSNY

SEQ ID NO: 959 - protein, 7 aa, synthetic construct
GRRFSAD

SEQ ID NO: 960 - protein, 7 aa, synthetic construct
GSTFSKA

SEQ ID NO: 961 - protein, 7 aa, synthetic construct
GRTFSSL

SEQ ID NO: 962 - protein, 7 aa, synthetic construct
GFTFGDY

SEQ ID NO: 963 - protein, 7 aa, synthetic construct
GFTFDDR

SEQ ID NO: 964 - protein, 7 aa, synthetic construct
GRTFSSY

SEQ ID NO: 965 - protein, 7 aa, synthetic construct
GRTFSIS

SEQ ID NO: 966 - protein, 7 aa, synthetic construct
GRTFSTS

SEQ ID NO: 967 - protein, 7 aa, synthetic construct
GRTFSLY

SEQ ID NO: 968 - protein, 7 aa, synthetic construct
GFTFTNY

SEQ ID NO: 969 - protein, 7 aa, synthetic construct
GRSFGNF

SEQ ID NO: 970 - protein, 7 aa, synthetic construct
GRTFSSL

SEQ ID NO: 971 - protein, 7 aa, synthetic construct
GRTLSSI

SEQ ID NO: 972 - protein, 7 aa, synthetic construct
GRTFSNF

SEQ ID NO: 973 - skipped

SEQ ID NO: 974 - protein, 7 aa, synthetic construct
GTSFSVG

SEQ ID NO: 975 - protein, 7 aa, synthetic construct
GRTFSSL

SEQ ID NO: 976 - protein, 7 aa, synthetic construct
GRTLSRS

SEQ ID NO: 977 - protein, 7 aa, synthetic construct
GRTISNY

SEQ ID NO: 978 - protein, 7 aa, synthetic construct
GHTFRGY

SEQ ID NO: 979 - protein, 7 aa, synthetic construct
GSIVRGN

SEQ ID NO: 980 - protein, 7 aa, synthetic construct
GRTFSSY

SEQ ID NO: 981 - protein, 7 aa, synthetic construct
GNIFGVN

SEQ ID NO: 982 - protein, 7 aa, synthetic construct
GHTFRGY

SEQ ID NO: 983 - protein, 7 aa, synthetic construct
GRTLRRY

SEQ ID NO: 984 - protein, 7 aa, synthetic construct
GRALSSS

SEQ ID NO: 985 - protein, 7 aa, synthetic construct
GRTFSNG

SEQ ID NO: 986 - protein, 7 aa, synthetic construct
GLTFGSA

SEQ ID NO: 987 - protein, 7 aa, synthetic construct
GFTFGST

SEQ ID NO: 988 - protein, 7 aa, synthetic construct
GRFTSSS

SEQ ID NO: 989 - protein, 7 aa, synthetic construct
GRTFNSR

SEQ ID NO: 990 - protein, 6 aa, synthetic construct
GRTLSS

SEQ ID NO: 991 - protein, 7 aa, synthetic construct
GGTFSRY

SEQ ID NO: 992 - protein, 7 aa, synthetic construct
GRTFNSR

SEQ ID NO: 993 - protein, 7 aa, synthetic construct
GSTFRGA

SEQ ID NO: 994 - protein, 7 aa, synthetic construct
GSTFSKA

SEQ ID NO: 995 - protein, 7 aa, synthetic construct
GTTFRIN

SEQ ID NO: 996 - protein, 7 aa, synthetic construct
GFPVNRY

SEQ ID NO: 997 - protein, 7 aa, synthetic construct
GHTFNTY

SEQ ID NO: 998 - protein, 7 aa, synthetic construct
GRTFGRR

SEQ ID NO: 999 - protein, 7 aa, synthetic construct
GFTFSSY

SEQ ID NO: 1000 - protein, 7 aa, synthetic construct
GRTFSNF

SEQ ID NO: 1001 - protein, 6 aa, synthetic construct
GLTTVY

SEQ ID NO: 1002 - protein, 7 aa, synthetic construct
GTTFRIN

SEQ ID NO: 1003 - protein, 7 aa, synthetic construct
GRTFSTH

SEQ ID NO: 1004 - protein, 7 aa, synthetic construct
GIPSTLR

SEQ ID NO: 1005 - protein, 7 aa, synthetic construct
GRTFSSY

SEQ ID NO: 1006 - protein, 7 aa, synthetic construct
GRTFSDI

SEQ ID NO: 1007 - protein, 7 aa, synthetic construct
GIPFSTR

SEQ ID NO: 1008 - protein, 7 aa, synthetic construct
GFTFDEY

SEQ ID NO: 1009 - protein, 7 aa, synthetic construct
GFTFSNY

SEQ ID NO: 1010 - protein, 7 aa, synthetic construct
GITFKRY

SEQ ID NO: 1011 - protein, 7 aa, synthetic construct
GFTFGHY

SEQ ID NO: 1012 - protein, 7 aa, synthetic construct
GSITSIN

SEQ ID NO: 1013 - protein, 8 aa, synthetic construct
GGRIFSNY

SEQ ID NO: 1014 - protein, 4 aa, synthetic construct
GRTF

SEQ ID NO: 1015 - protein, 7 aa, synthetic construct
GGTFNGR

SEQ ID NO: 1016 - protein, 7 aa, synthetic construct
GFNFDDY

SEQ ID NO: 1017 - protein, 9 aa, synthetic construct
SIGIAFSSR

SEQ ID NO: 1018 - protein, 7 aa, synthetic construct
GSTFRIN

SEQ ID NO: 1019 - protein, 7 aa, synthetic construct
GGIYRVN

SEQ ID NO: 1020 - protein, 7 aa, synthetic construct
GRSLNTY

SEQ ID NO: 1021 - protein, 7 aa, synthetic construct
GRTFSNY

SEQ ID NO: 1022 - protein, 7 aa, synthetic construct
GTTVRIR

SEQ ID NO: 1023 - protein, 7 aa, synthetic construct
GRTFSTY

SEQ ID NO: 1024 - protein, 7 aa, synthetic construct
GIPFSTR

SEQ ID NO: 1025 - protein, 7 aa, synthetic construct
GRTFSRY

SEQ ID NO: 1026 - protein, 7 aa, synthetic construct
GHTFNTY

SEQ ID NO: 1027 - protein, 7 aa, synthetic construct
GRSFSEY

SEQ ID NO: 1028 - protein, 7 aa, synthetic construct
GRTFTTY

SEQ ID NO: 1029 - protein, 7 aa, synthetic construct
GRTFSRY

SEQ ID NO: 1030 - protein, 7 aa, synthetic construct
GSIFTIN

SEQ ID NO: 1031 - protein, 7 aa, synthetic construct
GTSISNR

SEQ ID NO: 1032 - protein, 8 aa, synthetic construct
GFTFRRYV

SEQ ID NO: 1033 - protein, 8 aa, synthetic construct
GFTFNKYP

SEQ ID NO: 1034 - protein, 8 aa, synthetic construct
GFTFSSAA

SEQ ID NO: 1035 - protein, 8 aa, synthetic construct
GFTFNKYP

SEQ ID NO: 1036 - protein, 8 aa, synthetic construct
GFTFDRYR

SEQ ID NO: 1037 - protein, 8 aa, synthetic construct
GFTSNNFA

SEQ ID NO: 1038 - protein, 8 aa, synthetic construct
GFTFGNYA

SEQ ID NO: 1039 - protein, 8 aa, synthetic construct
GFTFDRYR

SEQ ID NO: 1040 - protein, 8 aa, synthetic construct
GLTFPNYG

SEQ ID NO: 1041 - protein, 8 aa, synthetic construct
GFTFNKYP

SEQ ID NO: 1042 - protein, 8 aa, synthetic construct
GFTFTHYS

SEQ ID NO: 1043 - protein, 8 aa, synthetic construct
GFTFEEKE

SEQ ID NO: 1044 - protein, 8 aa, synthetic construct
GFTFDRYR

SEQ ID NO: 1045 - protein, 8 aa, synthetic construct
GFTFHKYG

SEQ ID NO: 1046 - protein, 8 aa, synthetic construct
GFTFGNYA

SEQ ID NO: 1047 - protein, 8 aa, synthetic construct
GFTFAKYK

SEQ ID NO: 1048 - protein, 8 aa, synthetic construct
GFTFSSYF

SEQ ID NO: 1049 - protein, 8 aa, synthetic construct
GFTFDRYR

SEQ ID NO: 1050 - protein, 8 aa, synthetic construct
GFTFSRYA

SEQ ID NO: 1051 - protein, 8 aa, synthetic construct
GFTFRSYT

SEQ ID NO: 1052 - protein, 8 aa, synthetic construct
GFTFSDYD

SEQ ID NO: 1053 - protein, 8 aa, synthetic construct
GFTFRRYV

SEQ ID NO: 1054 - protein, 8 aa, synthetic construct
GGFSLSRY

SEQ ID NO: 1055 - protein, 8 aa, synthetic construct
GFTFHKYG

SEQ ID NO: 1056 - protein, 8 aa, synthetic construct
GFTFNKYP

SEQ ID NO: 1057 - protein, 8 aa, synthetic construct
GFTFNKYP

SEQ ID NO: 1058 - protein, 8 aa, synthetic construct
GFTFRRYV

SEQ ID NO: 1059 - protein, 8 aa, synthetic construct
GFTFSRYA

SEQ ID NO: 1060 - protein, 8 aa, synthetic construct
GFTFRRYV

SEQ ID NO: 1061 - protein, 8 aa, synthetic construct
GFTFSSYV

SEQ ID NO: 1062 - protein, 8 aa, synthetic construct
GFTFEDYQ

SEQ ID NO: 1063 - protein, 8 aa, synthetic construct
GFTFRRYV

SEQ ID NO: 1064 - protein, 8 aa, synthetic construct
GFTFKAYE

SEQ ID NO: 1065 - protein, 8 aa, synthetic construct
GFTFEVYT

SEQ ID NO: 1066 - protein, 8 aa, synthetic construct
GFTFGNYS

SEQ ID NO: 1067 - protein, 8 aa, synthetic construct
GFTFRRYV

SEQ ID NO: 1068 - protein, 8 aa, synthetic construct
GFTFSNYG

SEQ ID NO: 1069 - protein, 8 aa, synthetic construct
GFTFAHEP

SEQ ID NO: 1070 - protein, 8 aa, synthetic construct
GFTFHEST

SEQ ID NO: 1071 - protein, 8 aa, synthetic construct
GFTFNKYP

SEQ ID NO: 1072 - protein, 8 aa, synthetic construct
GFTFNKYP

SEQ ID NO: 1073 - protein, 8 aa, synthetic construct
GFTFHKYG

SEQ ID NO: 1074 - protein, 8 aa, synthetic construct
GLTFPNYG

SEQ ID NO: 1075 - protein, 8 aa, synthetic construct
GFTFKAYE

SEQ ID NO: 1076 - protein, 8 aa, synthetic construct
GFTFRRYV

SEQ ID NO: 1077 - protein, 8 aa, synthetic construct
GFTFRRYV

SEQ ID NO: 1078 - protein, 8 aa, synthetic construct
GFTSNNFA

SEQ ID NO: 1079 - protein, 8 aa, synthetic construct
GFTFGNYA

SEQ ID NO: 1080 - protein, 8 aa, synthetic construct
GFTFEDET

SEQ ID NO: 1081 - protein, 8 aa, synthetic construct
GFTFSNSY

SEQ ID NO: 1082 - protein, 8 aa, synthetic construct
GFTFSGYD

SEQ ID NO: 1083 - protein, 8 aa, synthetic construct
GFTFRRYV

SEQ ID NO: 1084 - protein, 8 aa, synthetic construct
GFTFKSYG

SEQ ID NO: 1085 - protein, 8 aa, synthetic construct
GFTFRRYV

SEQ ID NO: 1086 - protein, 8 aa, synthetic construct
GFTFVAYN

SEQ ID NO: 1087 - protein, 8 aa, synthetic construct
GFTFRRYV

SEQ ID NO: 1088 - protein, 8 aa, synthetic construct
GFTFRRYV

SEQ ID NO: 1089 - protein, 8 aa, synthetic construct
GFTFSRYG

SEQ ID NO: 1090 - protein, 8 aa, synthetic construct
GFTFGNYA

SEQ ID NO: 1091 - protein, 9 aa, synthetic construct
GYSISSGYH

SEQ ID NO: 1092 - protein, 8 aa, synthetic construct
GFTFRRYV

SEQ ID NO: 1093 - protein, 8 aa, synthetic construct
GFTFHKYG

SEQ ID NO: 1094 - protein, 8 aa, synthetic construct
GFTFRRYV

SEQ ID NO: 1095 - protein, 8 aa, synthetic construct
GFTFNKYP

SEQ ID NO: 1096 - protein, 8 aa, synthetic construct
GFTFRRYV

SEQ ID NO: 1097 - protein, 8 aa, synthetic construct
GFTFRRYV

SEQ ID NO: 1098 - protein, 8 aa, synthetic construct
GFTFSSYV

SEQ ID NO: 1099 - protein, 8 aa, synthetic construct
GFTFRRYV

SEQ ID NO: 1100 - protein, 8 aa, synthetic construct
GFTSNNFA

SEQ ID NO: 1101 - protein, 8 aa, synthetic construct
GFTFNKYP

SEQ ID NO: 1102 - protein, 8 aa, synthetic construct
GFTFFPYA

SEQ ID NO: 1103 - protein, 8 aa, synthetic construct
GFTFDQYD

SEQ ID NO: 1104 - protein, 8 aa, synthetic construct
GFTFRRYV

SEQ ID NO: 1105 - protein, 8 aa, synthetic construct
GFTFRSYT

SEQ ID NO: 1106 - protein, 8 aa, synthetic construct
GFTFRRYV

SEQ ID NO: 1107 - protein, 8 aa, synthetic construct
GFTFGNYA

SEQ ID NO: 1108 - protein, 8 aa, synthetic construct
GFTFNKYP

SEQ ID NO: 1109 - protein, 8 aa, synthetic construct
GFTFHKYG

SEQ ID NO: 1110 - protein, 8 aa, synthetic construct
GFTFSSYW

SEQ ID NO: 1111 - protein, 8 aa, synthetic construct
GFTFGNYA

SEQ ID NO: 1112 - protein, 8 aa, synthetic construct
GFTFRSYT

SEQ ID NO: 1113 - protein, 8 aa, synthetic construct
GFTFSRYF

SEQ ID NO: 1114 - protein, 8 aa, synthetic construct
GFTFNKYP

SEQ ID NO: 1115 - protein, 8 aa, synthetic construct
GFTFSRYF

SEQ ID NO: 1116 - protein, 8 aa, synthetic construct
GFTFDRYR

SEQ ID NO: 1117 - protein, 8 aa, synthetic construct
GFTFTHYS

SEQ ID NO: 1118 - protein, 8 aa, synthetic construct
GFTFSPYL

SEQ ID NO: 1119 - protein, 8 aa, synthetic construct
GFTFSNYF

SEQ ID NO: 1120 - protein, 8 aa, synthetic construct
GFTFRRYV

SEQ ID NO: 1121 - protein, 8 aa, synthetic construct
GFTFNKYP

SEQ ID NO: 1122 - protein, 8 aa, synthetic construct
GFTFKSYG

SEQ ID NO: 1123 - protein, 8 aa, synthetic construct
GFTFNKYP

SEQ ID NO: 1124 - protein, 8 aa, synthetic construct
GFTFRRYV

SEQ ID NO: 1125 - protein, 8 aa, synthetic construct
GFTFEDET

SEQ ID NO: 1126 - protein, 8 aa, synthetic construct
GFTFNKYP

SEQ ID NO: 1127 - protein, 8 aa, synthetic construct
GFTFRRYV

SEQ ID NO: 1128 - protein, 8 aa, synthetic construct
GFTFNKYP

SEQ ID NO: 1129 - protein, 8 aa, synthetic construct
GFTFSRYF

SEQ ID NO: 1130 - protein, 8 aa, synthetic construct
GFTFNKYP

SEQ ID NO: 1131 - protein, 8 aa, synthetic construct
GFTFHKYG

SEQ ID NO: 1132 - protein, 8 aa, synthetic construct
GFTFRRYV

SEQ ID NO: 1133 - protein, 8 aa, synthetic construct
GFTFRRYV

SEQ ID NO: 1134 - protein, 8 aa, synthetic construct
GFTFGNYA

SEQ ID NO: 1135 - protein, 8 aa, synthetic construct
GFTLDYLA

SEQ ID NO: 1136 - protein, 8 aa, synthetic construct
GFTFTHYS

SEQ ID NO: 1137 - protein, 8 aa, synthetic construct
GFTFRRYV

SEQ ID NO: 1138 - protein, 8 aa, synthetic construct
GFTFRRYV

SEQ ID NO: 1139 - protein, 8 aa, synthetic construct
GFTFPVYN

SEQ ID NO: 1140 - protein, 8 aa, synthetic construct
GFTFRRYV

SEQ ID NO: 1141 - protein, 8 aa, synthetic construct
GFSFSAYA

SEQ ID NO: 1142 - protein, 8 aa, synthetic construct
GFTFSRFA

SEQ ID NO: 1143 - protein, 8 aa, synthetic construct
GFTFTSYA

SEQ ID NO: 1144 - protein, 8 aa, synthetic construct
GFTFSSYA

SEQ ID NO: 1145 - protein, 8 aa, synthetic construct
GSTFNNYA

SEQ ID NO: 1146 - protein, 8 aa, synthetic construct
GFTFGRFA

SEQ ID NO: 1147 - protein, 8 aa, synthetic construct
GFTFSKYA

SEQ ID NO: 1148 - protein, 8 aa, synthetic construct
GFTFSRYA

SEQ ID NO: 1149 - protein, 8 aa, synthetic construct
GFTFSRSA

SEQ ID NO: 1150 - protein, 8 aa, synthetic construct
GFTFRNYA

SEQ ID NO: 1151 - protein, 8 aa, synthetic construct
GFTFSNYA

SEQ ID NO: 1152 - protein, 8 aa, synthetic construct
GFTFSSYA

SEQ ID NO: 1153 - protein, 8 aa, synthetic construct
GFTFSSYA

SEQ ID NO: 1154 - protein, 8 aa, synthetic construct
GFSFNNYA

SEQ ID NO: 1155 - protein, 8 aa, synthetic construct
GFTFRRYA

SEQ ID NO: 1156 - protein, 8 aa, synthetic construct
GFTFRSYG

SEQ ID NO: 1157 - protein, 8 aa, synthetic construct
GFTFANYA

SEQ ID NO: 1158 - protein, 8 aa, synthetic construct
GFTFGRFA

SEQ ID NO: 1159 - protein, 8 aa, synthetic construct
GFTFRTSA

SEQ ID NO: 1160 - protein, 8 aa, synthetic construct
GFTFSSYA

SEQ ID NO: 1161 - protein, 8 aa, synthetic construct
GIHLSSYA

SEQ ID NO: 1162 - protein, 8 aa, synthetic construct
GFTFSKYA

SEQ ID NO: 1163 - protein, 8 aa, synthetic construct
GFPFSSYA

SEQ ID NO: 1164 - protein, 8 aa, synthetic construct
GFSFSAYA

SEQ ID NO: 1165 - protein, 8 aa, synthetic construct
GSPFSNYA

SEQ ID NO: 1166 - protein, 8 aa, synthetic construct
GFSFSGYA

SEQ ID NO: 1167 - protein, 8 aa, synthetic construct
GFTFRTYG

SEQ ID NO: 1168 - protein, 8 aa, synthetic construct
GLTFSRYA

SEQ ID NO: 1169 - protein, 8 aa, synthetic construct
GFAFSTSA

SEQ ID NO: 1170 - protein, 8 aa, synthetic construct
GFTFGAYA

SEQ ID NO: 1171 - protein, 8 aa, synthetic construct
GFTFRRYA

SEQ ID NO: 1172 - protein, 8 aa, synthetic construct
GFTFSKHA

SEQ ID NO: 1173 - protein, 8 aa, synthetic construct
GFTFRRSA

SEQ ID NO: 1174 - protein, 8 aa, synthetic construct
GFSFRSYA

SEQ ID NO: 1175 - protein, 8 aa, synthetic construct
GFTFSSSS

SEQ ID NO: 1176 - protein, 8 aa, synthetic construct
GFTFSRFA

SEQ ID NO: 1177 - protein, 8 aa, synthetic construct
GFSFSTYA

SEQ ID NO: 1178 - protein, 8 aa, synthetic construct
GFTFSRYT

SEQ ID NO: 1179 - protein, 8 aa, synthetic construct
GLTFRSYA

SEQ ID NO: 1180 - protein, 8 aa, synthetic construct
GFTFSNYA

SEQ ID NO: 1181 - protein, 8 aa, synthetic construct
GFNFRDYA

SEQ ID NO: 1182 - protein, 8 aa, synthetic construct
GFTFSGYV

SEQ ID NO: 1183 - protein, 8 aa, synthetic construct
GFTFSTFA

SEQ ID NO: 1184 - protein, 8 aa, synthetic construct
GFTLSTYA

SEQ ID NO: 1185 - protein, 8 aa, synthetic construct
GLTFNNYA

SEQ ID NO: 1186 - protein, 8 aa, synthetic construct
GFTFGRYA

SEQ ID NO: 1187 - protein, 8 aa, synthetic construct
GFSFSAYA

SEQ ID NO: 1188 - protein, 8 aa, synthetic construct
GFTFGRYA

SEQ ID NO: 1189 - protein, 8 aa, synthetic construct
GFTFSNYG

SEQ ID NO: 1190 - protein, 8 aa, synthetic construct
GFTFSYYG

SEQ ID NO: 1191 - protein, 8 aa, synthetic construct
GFTFTKYA

SEQ ID NO: 1192 - protein, 8 aa, synthetic construct
GFTFRSYG

SEQ ID NO: 1193 - protein, 8 aa, synthetic construct
GFNFRSYA

SEQ ID NO: 1194 - protein, 8 aa, synthetic construct
GFSFSAYA

SEQ ID NO: 1195 - protein, 8 aa, synthetic construct
GFTFGNYA

SEQ ID NO: 1196 - protein, 8 aa, synthetic construct
GFSFSSYA

SEQ ID NO: 1197 - protein, 8 aa, synthetic construct
GFTFGRFA

SEQ ID NO: 1198 - protein, 8 aa, synthetic construct
GFTFGNYA

SEQ ID NO: 1199 - protein, 8 aa, synthetic construct
GFTFNKFA

SEQ ID NO: 1200 - protein, 8 aa, synthetic construct
GLTFSSYA

SEQ ID NO: 1201 - protein, 8 aa, synthetic construct
GFTLRSYA

SEQ ID NO: 1202 - protein, 8 aa, synthetic construct
GFTFSSFA

SEQ ID NO: 1203 - protein, 8 aa, synthetic construct
GSTFSSYA

SEQ ID NO: 1204 - protein, 8 aa, synthetic construct
GFTFRRSA

SEQ ID NO: 1205 - protein, 8 aa, synthetic construct
GFTFAGYA

SEQ ID NO: 1206 - protein, 8 aa, synthetic construct
GFTFRTFA

SEQ ID NO: 1207 - protein, 8 aa, synthetic construct
GFTFSRYA

SEQ ID NO: 1208 - protein, 8 aa, synthetic construct
GFTFDNYA

SEQ ID NO: 1209 - protein, 8 aa, synthetic construct
GFRFSSYA

SEQ ID NO: 1210 - protein, 8 aa, synthetic construct
GFTFRSYA

SEQ ID NO: 1211 - protein, 8 aa, synthetic construct
GFTFSKFA

SEQ ID NO: 1212 - protein, 8 aa, synthetic construct
GFTFSSSG

SEQ ID NO: 1213 - protein, 8 aa, synthetic construct
GFSFSSFA

SEQ ID NO: 1214 - protein, 8 aa, synthetic construct
GFTFGRFA

SEQ ID NO: 1215 - protein, 8 aa, synthetic construct
GFGFSSYA

SEQ ID NO: 1216 - protein, 8 aa, synthetic construct
GVTFRNYA

SEQ ID NO: 1217 - protein, 8 aa, synthetic construct
GFTFRNYA

SEQ ID NO: 1218 - protein, 8 aa, synthetic construct
GFTFRSSA

SEQ ID NO: 1219 - protein, 8 aa, synthetic construct
GFTFSRFA

SEQ ID NO: 1220 - protein, 8 aa, synthetic construct
GFTFGNYA

SEQ ID NO: 1221 - protein, 8 aa, synthetic construct
GFTYSSYA

SEQ ID NO: 1222 - protein, 8 aa, synthetic construct
GFTFSTYG

SEQ ID NO: 1223 - protein, 8 aa, synthetic construct
GFTFSSSG

SEQ ID NO: 1224 - protein, 8 aa, synthetic construct
GFSFSSSA

SEQ ID NO: 1225 - protein, 8 aa, synthetic construct
GFTFSRYA

SEQ ID NO: 1226 - protein, 8 aa, synthetic construct
GFTFSGYA

SEQ ID NO: 1227 - protein, 8 aa, synthetic construct
GFTFNKFA

SEQ ID NO: 1228 - protein, 8 aa, synthetic construct
GFTFSSHV

SEQ ID NO: 1229 - protein, 8 aa, synthetic construct
GFTFGRYA

SEQ ID NO: 1230 - protein, 8 aa, synthetic construct
GFTFNTYG

SEQ ID NO: 1231 - protein, 8 aa, synthetic construct
GFTVSSYA

SEQ ID NO: 1232 - protein, 8 aa, synthetic construct
GFTFSRSA

SEQ ID NO: 1233 - protein, 8 aa, synthetic construct
GFTFRSYD

SEQ ID NO: 1234 - protein, 8 aa, synthetic construct
GFAFTTYA

SEQ ID NO: 1235 - protein, 8 aa, synthetic construct
GFTFSSYD

SEQ ID NO: 1236 - protein, 8 aa, synthetic construct
GFSFSAYA

SEQ ID NO: 1237 - protein, 8 aa, synthetic construct
GFTFSRFA

SEQ ID NO: 1238 - protein, 7 aa, synthetic construct
GIPFSSR

SEQ ID NO: 1239 - protein, 7 aa, synthetic construct
GGIYRVN

SEQ ID NO: 1240 - protein, 7 aa, synthetic construct
GFLMYDR

SEQ ID NO: 1241 - protein, 7 aa, synthetic construct
GRTFSRF

SEQ ID NO: 1242 - protein, 7 aa, synthetic construct
GTTFRIN

SEQ ID NO: 1243 - protein, 7 aa, synthetic construct
GRTFSNN

SEQ ID NO: 1244 - protein, 7 aa, synthetic construct
GRTFSDI

SEQ ID NO: 1245 - protein, 7 aa, synthetic construct
GHTYNTY

SEQ ID NO: 1246 - protein, 7 aa, synthetic construct
GRSLYDR

SEQ ID NO: 1247 - protein, 7 aa, synthetic construct
GRTFNNY

SEQ ID NO: 1248 - protein, 7 aa, synthetic construct
GRTLYSY

SEQ ID NO: 1249 - protein, 6 aa, synthetic construct
GTFRDY

SEQ ID NO: 1250 - protein, 8 aa, synthetic construct
GGGTFGSY

SEQ ID NO: 1251 - protein, 7 aa, synthetic construct
GRTFSNY

SEQ ID NO: 1252 - protein, 7 aa, synthetic construct
GRTFTNY

SEQ ID NO: 1253 - protein, 7 aa, synthetic construct
GRTFSTH

SEQ ID NO: 1254 - protein, 7 aa, synthetic construct
GRSFSMY

SEQ ID NO: 1255 - protein, 7 aa, synthetic construct
GLTFRNY

SEQ ID NO: 1256 - protein, 7 aa, synthetic construct
GFTFDDR

SEQ ID NO: 1257 - protein, 6 aa, synthetic construct
GRTFSS

SEQ ID NO: 1258 - protein, 7 aa, synthetic construct
GHTFNTY

SEQ ID NO: 1259 - protein, 4 aa, synthetic construct
GRIF

SEQ ID NO: 1260 - protein, 7 aa, synthetic construct
GRSFSEY

SEQ ID NO: 1261 - protein, 7 aa, synthetic construct
GFNSGSY

SEQ ID NO: 1262 - protein, 5 aa, synthetic construct
GGTAY

SEQ ID NO: 1263 - protein, 7 aa, synthetic construct
GRTFTSY

SEQ ID NO: 1264 - protein, 7 aa, synthetic construct
GSTFRIN

SEQ ID NO: 1265 - protein, 9 aa, synthetic construct
GGTLNNNPM

SEQ ID NO: 1266 - protein, 7 aa, synthetic construct
GRTFSTY

SEQ ID NO: 1267 - protein, 7 aa, synthetic construct
GRTFNSY

SEQ ID NO: 1268 - protein, 7 aa, synthetic construct
GIPFSSR

SEQ ID NO: 1269 - protein, 7 aa, synthetic construct
GIDVNRN

SEQ ID NO: 1270 - protein, 7 aa, synthetic construct
GINFSRY

SEQ ID NO: 1271 - protein, 7 aa, synthetic construct
GGTLRGY

SEQ ID NO: 1272 - protein, 4 aa, synthetic construct
GQTF

SEQ ID NO: 1273 - protein, 7 aa, synthetic construct
GYTFRAY

SEQ ID NO: 1274 - protein, 7 aa, synthetic construct
GNIFTLN

SEQ ID NO: 1275 - protein, 7 aa, synthetic construct
GFRMYDR

SEQ ID NO: 1276 - protein, 7 aa, synthetic construct
GFTFSMW

SEQ ID NO: 1277 - protein, 7 aa, synthetic construct
GFTFRSY

SEQ ID NO: 1278 - protein, 7 aa, synthetic construct
GLPFSTK

SEQ ID NO: 1279 - protein, 7 aa, synthetic construct
GNIFRIN

SEQ ID NO: 1280 - protein, 7 aa, synthetic construct
GGTFGHY

SEQ ID NO: 1281 - protein, 7 aa, synthetic construct
GRTFNSY

SEQ ID NO: 1282 - protein, 7 aa, synthetic construct
GITFRRY

SEQ ID NO: 1283 - protein, 7 aa, synthetic construct
GRTFSYN

SEQ ID NO: 1284 - protein, 7 aa, synthetic construct
GRTFSSL

SEQ ID NO: 1285 - protein, 7 aa, synthetic construct
GPTFSTN

SEQ ID NO: 1286 - protein, 7 aa, synthetic construct
GRTFSNY

SEQ ID NO: 1287 - protein, 7 aa, synthetic construct
GRAIGSY

SEQ ID NO: 1288 - protein, 7 aa, synthetic construct
GRTLSRN

SEQ ID NO: 1289 - protein, 7 aa, synthetic construct
GRTFIGY

SEQ ID NO: 1290 - protein, 7 aa, synthetic construct
GRTISNY

SEQ ID NO: 1291 - protein, 7 aa, synthetic construct
GRTISNY

SEQ ID NO: 1292 - protein, 6 aa, synthetic construct
GTFTSY

SEQ ID NO: 1293 - protein, 7 aa, synthetic construct
GRSFSMY

SEQ ID NO: 1294 - protein, 7 aa, synthetic construct
GLTFRNY

SEQ ID NO: 1295 - protein, 7 aa, synthetic construct
GFTFSSY

SEQ ID NO: 1296 - protein, 7 aa, synthetic construct
GRTHSIY

SEQ ID NO: 1297 - protein, 7 aa, synthetic construct
GFSLDYV

SEQ ID NO: 1298 - protein, 7 aa, synthetic construct
GSIFRVN

SEQ ID NO: 1299 - protein, 7 aa, synthetic construct
GRTFSSL

SEQ ID NO: 1300 - protein, 7 aa, synthetic construct
GFLMYDR

SEQ ID NO: 1301 - protein, 6 aa, synthetic construct
GDISSY

SEQ ID NO: 1302 - protein, 7 aa, synthetic construct
GRTHSIY

SEQ ID NO: 1303 - protein, 7 aa, synthetic construct
GIPFSSR

SEQ ID NO: 1304 - protein, 7 aa, synthetic construct
GRTFSNY

SEQ ID NO: 1305 - protein, 6 aa, synthetic construct
GMTTIG

SEQ ID NO: 1306 - protein, 7 aa, synthetic construct
GRASGDY

SEQ ID NO: 1307 - protein, 7 aa, synthetic construct
GRTFSSY

SEQ ID NO: 1308 - protein, 7 aa, synthetic construct
GRTFSEV

SEQ ID NO: 1309 - protein, 7 aa, synthetic construct
GSTFSIN

SEQ ID NO: 1310 - protein, 4 aa, synthetic construct
GRTF

SEQ ID NO: 1311 - protein, 7 aa, synthetic construct
GGTFSSY

SEQ ID NO: 1312 - protein, 7 aa, synthetic construct
GRTFSNF

SEQ ID NO: 1313 - protein, 7 aa, synthetic construct
GGTFSRY

SEQ ID NO: 1314 - protein, 7 aa, synthetic construct
GRTLSRS

SEQ ID NO: 1315 - protein, 7 aa, synthetic construct
GRTFSSG

SEQ ID NO: 1316 - protein, 7 aa, synthetic construct
GRTFNSY

SEQ ID NO: 1317 - protein, 8 aa, synthetic construct
GYTLKNYY

SEQ ID NO: 1318 - protein, 7 aa, synthetic construct
GHTFNTY

SEQ ID NO: 1319 - protein, 7 aa, synthetic construct
GFTFDDR

SEQ ID NO: 1320 - protein, 7 aa, synthetic construct
GRTLSSY

SEQ ID NO: 1321 - protein, 7 aa, synthetic construct
GRIFTNT

SEQ ID NO: 1322 - protein, 4 aa, synthetic construct
GRIF

SEQ ID NO: 1323 - protein, 7 aa, synthetic construct
GNIFTRH

SEQ ID NO: 1324 - protein, 7 aa, synthetic construct
GRTFSNY

SEQ ID NO: 1325 - protein, 7 aa, synthetic construct
GRTFTSY

SEQ ID NO: 1326 - skipped

SEQ ID NO: 1327 - protein, 7 aa, synthetic construct
GRSFSEY

SEQ ID NO: 1328 - protein, 7 aa, synthetic construct
GRSFSSY

SEQ ID NO: 1329 - protein, 7 aa, synthetic construct
GLTFRNY

SEQ ID NO: 1330 - protein, 7 aa, synthetic construct
GSTFSSY

SEQ ID NO: 1331 - protein, 7 aa, synthetic construct
GIDVNRN

SEQ ID NO: 1332 - protein, 7 aa, synthetic construct
GGTFNVY

SEQ ID NO: 1333 - protein, 5 aa, synthetic construct
LRGGS

SEQ ID NO: 1334 - protein, 6 aa, synthetic construct
SWSVSS

SEQ ID NO: 1335 - protein, 6 aa, synthetic construct
NWSSRS

SEQ ID NO: 1336 - protein, 6 aa, synthetic construct
SSGGGI

SEQ ID NO: 1337 - protein, 6 aa, synthetic construct
SWSGAS

SEQ ID NO: 1338 - protein, 6 aa, synthetic construct
SWSGGS

SEQ ID NO: 1339 - protein, 6 aa, synthetic construct
SWTGGS

SEQ ID NO: 1340 - protein, 6 aa, synthetic construct
SWSGGR

SEQ ID NO: 1341 - protein, 6 aa, synthetic construct
SWSPGR

SEQ ID NO: 1342 - protein, 6 aa, synthetic construct
SWSGGR

SEQ ID NO: 1343 - protein, 5 aa, synthetic construct
ASNGN

SEQ ID NO: 1344 - protein, 6 aa, synthetic construct
SWSGGS

SEQ ID NO: 1345 - protein, 6 aa, synthetic construct
IWTGVS

SEQ ID NO: 1346 - protein, 7 aa, synthetic construct
TSRDGTT

SEQ ID NO: 1347 - protein, 6 aa, synthetic construct
NRGGST

SEQ ID NO: 1348 - protein, 6 aa, synthetic construct
SWSLSR

SEQ ID NO: 1349 - protein, 5 aa, synthetic construct
TSGGS

SEQ ID NO: 1350 - protein, 6 aa, synthetic construct
DTNGGH

SEQ ID NO: 1351 - protein, 6 aa, synthetic construct
SRTGSS

SEQ ID NO: 1352 - protein, 6 aa, synthetic construct
TRSGGK

SEQ ID NO: 1353 - protein, 5 aa, synthetic construct
LRGGS

SEQ ID NO: 1354 - protein, 6 aa, synthetic construct
SSSASS

SEQ ID NO: 1355 - protein, 5 aa, synthetic construct
SSGAT

SEQ ID NO: 1356 - protein, 6 aa, synthetic construct
SWSGSA

SEQ ID NO: 1357 - protein, 6 aa, synthetic construct
SRSGTG

SEQ ID NO: 1358 - protein, 6 aa, synthetic construct
NWSGGL

SEQ ID NO: 1359 - protein, 6 aa, synthetic construct
NWSGGS

SEQ ID NO: 1360 - protein, 5 aa, synthetic construct
RSGGT

SEQ ID NO: 1361 - protein, 6 aa, synthetic construct
SRSGAS

SEQ ID NO: 1362 - protein, 6 aa, synthetic construct
SRSGGS

SEQ ID NO: 1363 - protein, 6 aa, synthetic construct
STSGKT

SEQ ID NO: 1364 - protein, 6 aa, synthetic construct
SMSGKE

SEQ ID NO: 1365 - protein, 6 aa, synthetic construct
NLSSGS

SEQ ID NO: 1366 - protein, 5 aa, synthetic construct
SARGM

SEQ ID NO: 1367 - protein, 6 aa, synthetic construct
SRSGAS

SEQ ID NO: 1368 - protein, 6 aa, synthetic construct
SRSGGR

SEQ ID NO: 1369 - protein, 6 aa, synthetic construct
NRSGKS

SEQ ID NO: 1370 - protein, 6 aa, synthetic construct
SRSGGS

SEQ ID NO: 1371 - protein, 6 aa, synthetic construct
NRGGKI

SEQ ID NO: 1372 - protein, 6 aa, synthetic construct
SWSGGS

SEQ ID NO: 1373 - protein, 5 aa, synthetic construct
RSGGT

SEQ ID NO: 1374 - protein, 6 aa, synthetic construct
TFSGAR

SEQ ID NO: 1375 - protein, 6 aa, synthetic construct
SSSGGT

SEQ ID NO: 1376 - protein, 6 aa, synthetic construct
DWSGRR

SEQ ID NO: 1377 - protein, 5 aa, synthetic construct
STGGT

SEQ ID NO: 1378 - protein, 5 aa, synthetic construct
SRSGT

SEQ ID NO: 1379 - protein, 5 aa, synthetic construct
SPSGN

SEQ ID NO: 1380 - protein, 6 aa, synthetic construct
NRSGKT

SEQ ID NO: 1381 - protein, 6 aa, synthetic construct
NRSGKS

SEQ ID NO: 1382 - protein, 6 aa, synthetic construct
NWSGRR

SEQ ID NO: 1383 - protein, 5 aa, synthetic construct
TSGGS

SEQ ID NO: 1384 - protein, 5 aa, synthetic construct
SSGGS

SEQ ID NO: 1385 - protein, 5 aa, synthetic construct
TRAGS

SEQ ID NO: 1386 - protein, 5 aa, synthetic construct
SATGS

SEQ ID NO: 1387 - protein, 6 aa, synthetic construct
NRSGKS

SEQ ID NO: 1388 - protein, 6 aa, synthetic construct
SWSGGT

SEQ ID NO: 1389 - protein, 5 aa, synthetic construct
TSGGR

SEQ ID NO: 1390 - protein, 6 aa, synthetic construct
SWSGGS

SEQ ID NO: 1391 - protein, 6 aa, synthetic construct
SWRGGS

SEQ ID NO: 1392 - protein, 6 aa, synthetic construct
SGRSGN

SEQ ID NO: 1393 - protein, 6 aa, synthetic construct
SSSGSS

SEQ ID NO: 1394 - protein, 6 aa, synthetic construct
SRSGGS

SEQ ID NO: 1395 - protein, 6 aa, synthetic construct
SGTGGS

SEQ ID NO: 1396 - protein, 6 aa, synthetic construct
NRSGSS

SEQ ID NO: 1397 - protein, 5 aa, synthetic construct
ISDGN

SEQ ID NO: 1398 - protein, 5 aa, synthetic construct
WSGGR

SEQ ID NO: 1399 - protein, 5 aa, synthetic construct
TSTGS

SEQ ID NO: 1400 - protein, 5 aa, synthetic construct
TSGGR

SEQ ID NO: 1401 - protein, 6 aa, synthetic construct
NWSGRR

SEQ ID NO: 1402 - protein, 5 aa, synthetic construct
TSGGR

SEQ ID NO: 1403 - protein, 5 aa, synthetic construct
TSDGS

SEQ ID NO: 1404 - protein, 4 aa, synthetic construct
SQRG

SEQ ID NO: 1405 - protein, 6 aa, synthetic construct
NRSGKS

SEQ ID NO: 1406 - protein, 5 aa, synthetic construct
SSGST

SEQ ID NO: 1407 - protein, 6 aa, synthetic construct
TSAGGT

SEQ ID NO: 1408 - protein, 5 aa, synthetic construct
LSSGA

SEQ ID NO: 1409 - protein, 6 aa, synthetic construct
SRSGGS

SEQ ID NO: 1410 - protein, 6 aa, synthetic construct
SRSGGS

SEQ ID NO: 1411 - protein, 5 aa, synthetic construct
TSNGR

SEQ ID NO: 1412 - protein, 6 aa, synthetic construct
NWSGGS

SEQ ID NO: 1413 - protein, 6 aa, synthetic construct
SRSGGT

SEQ ID NO: 1414 - protein, 5 aa, synthetic construct
SSGGR

SEQ ID NO: 1415 - protein, 6 aa, synthetic construct
SRTGGS

SEQ ID NO: 1416 - protein, 6 aa, synthetic construct
NRSGKS

SEQ ID NO: 1417 - protein, 5 aa, synthetic construct
TRLGV

SEQ ID NO: 1418 - protein, 6 aa, synthetic construct
NWSGAS

SEQ ID NO: 1419 - protein, 6 aa, synthetic construct
DWSGSR

SEQ ID NO: 1420 - protein, 6 aa, synthetic construct
NWSGAR

SEQ ID NO: 1421 - protein, 6 aa, synthetic construct
SWSGGS

SEQ ID NO: 1422 - protein, 6 aa, synthetic construct
DWSGRR

SEQ ID NO: 1423 - protein, 6 aa, synthetic construct
SWSGGS

SEQ ID NO: 1424 - protein, 6 aa, synthetic construct
NWSGAS

SEQ ID NO: 1425 - protein, 6 aa, synthetic construct
SWSLTR

SEQ ID NO: 1426 - protein, 6 aa, synthetic construct
SRSGAS

SEQ ID NO: 1427 - protein, 6 aa, synthetic construct
SWSGGS

SEQ ID NO: 1428 - protein, 7 aa, synthetic construct
NWRSGGS

SEQ ID NO: 1429 - protein, 6 aa, synthetic construct
SRSGGG

SEQ ID NO: 1430 - protein, 6 aa, synthetic construct
SWSLSR

SEQ ID NO: 1431 - protein, 6 aa, synthetic construct
TRSGGK

SEQ ID NO: 1432 - protein, 5 aa, synthetic construct
SASGS

SEQ ID NO: 1433 - protein, 6 aa, synthetic construct
NWSGGS

SEQ ID NO: 1434 - protein, 5 aa, synthetic construct
ISGGS

SEQ ID NO: 1435 - protein, 6 aa, synthetic construct
STSGKT

SEQ ID NO: 1436 - protein, 5 aa, synthetic construct
NGGGN

SEQ ID NO: 1437 - protein, 6 aa, synthetic construct
NWSGSS

SEQ ID NO: 1438 - protein, 5 aa, synthetic construct
SSGAT

SEQ ID NO: 1439 - protein, 6 aa, synthetic construct
RIKDGS

SEQ ID NO: 1440 - protein, 6 aa, synthetic construct
SRSGGK

SEQ ID NO: 1441 - protein, 6 aa, synthetic construct
SRDGAA

SEQ ID NO: 1442 - protein, 6 aa, synthetic construct
SSSGSS

SEQ ID NO: 1443 - protein, 6 aa, synthetic construct
SWSGGS

SEQ ID NO: 1444 - protein, 6 aa, synthetic construct
NWSGSS

SEQ ID NO: 1445 - protein, 6 aa, synthetic construct
SSGGNL

SEQ ID NO: 1446 - protein, 8 aa, synthetic construct
IEGAGSDT

SEQ ID NO: 1447 - protein, 8 aa, synthetic construct
ISPSGKKK

SEQ ID NO: 1448 - protein, 8 aa, synthetic construct
ISGGGADT

SEQ ID NO: 1449 - protein, 8 aa, synthetic construct
IQQRGLKT

SEQ ID NO: 1450 - protein, 8 aa, synthetic construct
ISPSGKKK

SEQ ID NO: 1451 - protein, 8 aa, synthetic construct
ISGGGADT

SEQ ID NO: 1452 - protein, 8 aa, synthetic construct
ISSSGGET

SEQ ID NO: 1453 - protein, 8 aa, synthetic construct
ISPSGKKK

SEQ ID NO: 1454 - protein, 8 aa, synthetic construct
IDDRGRYT

SEQ ID NO: 1455 - protein, 7 aa, synthetic construct
ISNSGST

SEQ ID NO: 1456 - protein, 7 aa, synthetic construct
ITRSGST

SEQ ID NO: 1457 - protein, 8 aa, synthetic construct
ISSSGLWT

SEQ ID NO: 1458 - protein, 8 aa, synthetic construct
ISPSGKKK

SEQ ID NO: 1459 - protein, 8 aa, synthetic construct
ISPSGKKK

SEQ ID NO: 1460 - protein, 8 aa, synthetic construct
IWPRGQKT

SEQ ID NO: 1461 - protein, 8 aa, synthetic construct
ISPSGKKK

SEQ ID NO: 1462 - protein, 8 aa, synthetic construct
ISGGGADT

SEQ ID NO: 1463 - protein, 8 aa, synthetic construct
ISGYGSTT

SEQ ID NO: 1464 - protein, 8 aa, synthetic construct
IGANGAPT

SEQ ID NO: 1465 - protein, 8 aa, synthetic construct
ISNSGGST

SEQ ID NO: 1466 - protein, 8 aa, synthetic construct
IGASGSAT

SEQ ID NO: 1467 - protein, 8 aa, synthetic construct
ISPSGKKK

SEQ ID NO: 1468 - protein, 8 aa, synthetic construct
INQAGLRT

SEQ ID NO: 1469 - protein, 8 aa, synthetic construct
INPSRGYT

SEQ ID NO: 1470 - protein, 8 aa, synthetic construct
ISSSGGET

SEQ ID NO: 1471 - protein, 8 aa, synthetic construct
ISSSGSST

SEQ ID NO: 1472 - protein, 8 aa, synthetic construct
ISGGGADT

SEQ ID NO: 1473 - protein, 8 aa, synthetic construct
IGPSGGKT

SEQ ID NO: 1474 - protein, 8 aa, synthetic construct
ISGGGADT

SEQ ID NO: 1475 - protein, 8 aa, synthetic construct
IQQRGLKT

SEQ ID NO: 1476 - protein, 8 aa, synthetic construct
ITGTGGET

SEQ ID NO: 1477 - protein, 8 aa, synthetic construct
IYPSGGST

SEQ ID NO: 1478 - protein, 8 aa, synthetic construct
ISPSGGIT

SEQ ID NO: 1479 - protein, 8 aa, synthetic construct
ISGRGDNT

SEQ ID NO: 1480 - protein, 8 aa, synthetic construct
IWPRGQKT

SEQ ID NO: 1481 - protein, 8 aa, synthetic construct
VNPNSGTS

SEQ ID NO: 1482 - protein, 8 aa, synthetic construct
ISPSGGWT

SEQ ID NO: 1483 - protein, 7 aa, synthetic construct
INYAGNT

SEQ ID NO: 1484 - protein, 8 aa, synthetic construct
ISSSGGET

SEQ ID NO: 1485 - protein, 8 aa, synthetic construct
ISPSGKKK

SEQ ID NO: 1486 - protein, 8 aa, synthetic construct
ISPSGKKK

SEQ ID NO: 1487 - protein, 7 aa, synthetic construct
INYAGNT

SEQ ID NO: 1488 - protein, 8 aa, synthetic construct
ISPSGKKK

SEQ ID NO: 1489 - protein, 8 aa, synthetic construct
IIPNGGIT

SEQ ID NO: 1490 - protein, 8 aa, synthetic construct
IGASGSAT

SEQ ID NO: 1491 - protein, 8 aa, synthetic construct
ISGGGADT

SEQ ID NO: 1492 - protein, 8 aa, synthetic construct
ISGGGADT

SEQ ID NO: 1493 - protein, 8 aa, synthetic construct
IWARGQKT

SEQ ID NO: 1494 - protein, 8 aa, synthetic construct
IISSGGLT

SEQ ID NO: 1495 - protein, 8 aa, synthetic construct
ITPKGDHT

SEQ ID NO: 1496 - protein, 8 aa, synthetic construct
IGRHGGRT

SEQ ID NO: 1497 - protein, 8 aa, synthetic construct
IEGAGSDT

SEQ ID NO: 1498 - protein, 8 aa, synthetic construct
IWPRGQKT

SEQ ID NO: 1499 - protein, 8 aa, synthetic construct
ISGGGADT

SEQ ID NO: 1500 - protein, 8 aa, synthetic construct
ISNSGGST

SEQ ID NO: 1501 - protein, 8 aa, synthetic construct
ISSSGGET

SEQ ID NO: 1502 - protein, 8 aa, synthetic construct
IEGAGSDT

SEQ ID NO: 1503 - protein, 8 aa, synthetic construct
ISYGGSNK

SEQ ID NO: 1504 - protein, 8 aa, synthetic construct
IQQRGLKT

SEQ ID NO: 1505 - protein, 8 aa, synthetic construct
IDDRGRYT

SEQ ID NO: 1506 - protein, 8 aa, synthetic construct
ISGSGGGT

SEQ ID NO: 1507 - protein, 8 aa, synthetic construct
ISPSGKKK

SEQ ID NO: 1508 - protein, 8 aa, synthetic construct
VNPNSGAS

SEQ ID NO: 1509 - protein, 8 aa, synthetic construct
IYPSGGST

SEQ ID NO: 1510 - protein, 8 aa, synthetic construct
IEGAGSDT

SEQ ID NO: 1511 - protein, 8 aa, synthetic construct
IEGAGSDT

SEQ ID NO: 1512 - protein, 8 aa, synthetic construct
ISPSGKKK

SEQ ID NO: 1513 - protein, 8 aa, synthetic construct
ISGGGADT

SEQ ID NO: 1514 - protein, 8 aa, synthetic construct
INPSRGYT

SEQ ID NO: 1515 - protein, 8 aa, synthetic construct
ISPSGKKK

SEQ ID NO: 1516 - protein, 8 aa, synthetic construct
ISGGGADT

SEQ ID NO: 1517 - protein, 8 aa, synthetic construct
ITGSGGST

SEQ ID NO: 1518 - protein, 8 aa, synthetic construct
IEGAGSDT

SEQ ID NO: 1519 - protein, 8 aa, synthetic construct
ITGTGGET

SEQ ID NO: 1520 - protein, 8 aa, synthetic construct
IEARGGGT

SEQ ID NO: 1521 - protein, 8 aa, synthetic construct
IWPSGGQT

SEQ ID NO: 1522 - protein, 6 aa, synthetic construct
SNSGST

SEQ ID NO: 1523 - protein, 8 aa, synthetic construct
IGRHGGRT

SEQ ID NO: 1524 - protein, 8 aa, synthetic construct
IGPSGTST

SEQ ID NO: 1525 - protein, 8 aa, synthetic construct
IWPRGQKT

SEQ ID NO: 1526 - protein, 8 aa, synthetic construct
ISGGGADT

SEQ ID NO: 1527 - protein, 8 aa, synthetic construct
ISGRGDNT

SEQ ID NO: 1528 - protein, 8 aa, synthetic construct
IQQRGLKT

SEQ ID NO: 1529 - protein, 8 aa, synthetic construct
IDALGTDT

SEQ ID NO: 1530 - protein, 8 aa, synthetic construct
ISSTGFKT

SEQ ID NO: 1531 - protein, 8 aa, synthetic construct
INGTGGET

SEQ ID NO: 1532 - protein, 8 aa, synthetic construct
IGPSGTST

SEQ ID NO: 1533 - protein, 8 aa, synthetic construct
IDDRGRYT

SEQ ID NO: 1534 - protein, 8 aa, synthetic construct
ISGGGADT

SEQ ID NO: 1535 - protein, 8 aa, synthetic construct
ISSSGGET

SEQ ID NO: 1536 - protein, 8 aa, synthetic construct
IGRHGGRT

SEQ ID NO: 1537 - protein, 8 aa, synthetic construct
IGPSGGKT

SEQ ID NO: 1538 - protein, 8 aa, synthetic construct
ISGGGADT

SEQ ID NO: 1539 - protein, 8 aa, synthetic construct
IISSGGLT

SEQ ID NO: 1540 - protein, 7 aa, synthetic construct
ITRSGST

SEQ ID NO: 1541 - protein, 8 aa, synthetic construct
ISGGGADT

SEQ ID NO: 1542 - protein, 8 aa, synthetic construct
ISPSGKKK

SEQ ID NO: 1543 - protein, 8 aa, synthetic construct
ISPSGKKK

SEQ ID NO: 1544 - protein, 8 aa, synthetic construct
IEGRGTET

SEQ ID NO: 1545 - protein, 8 aa, synthetic construct
ISPSGKKK

SEQ ID NO: 1546 - protein, 8 aa, synthetic construct
ISPSGKKK

SEQ ID NO: 1547 - protein, 8 aa, synthetic construct
ISGGGADT

SEQ ID NO: 1548 - protein, 8 aa, synthetic construct
ISPIGPRT

SEQ ID NO: 1549 - protein, 8 aa, synthetic construct
ISPSGKKK

SEQ ID NO: 1550 - protein, 8 aa, synthetic construct
ISGGGADT

SEQ ID NO: 1551 - protein, 8 aa, synthetic construct
ITGTGGET

SEQ ID NO: 1552 - protein, 8 aa, synthetic construct
ISPSGHGT

SEQ ID NO: 1553 - protein, 8 aa, synthetic construct
ISESGTTT

SEQ ID NO: 1554 - protein, 8 aa, synthetic construct
ISGGGADT

SEQ ID NO: 1555 - protein, 8 aa, synthetic construct
ISTSGGST

SEQ ID NO: 1556 - protein, 8 aa, synthetic construct
ISGSGAYT

SEQ ID NO: 1557 - protein, 8 aa, synthetic construct
VSGSGGTT

SEQ ID NO: 1558 - protein, 8 aa, synthetic construct
ISGGGGAT

SEQ ID NO: 1559 - protein, 8 aa, synthetic construct
ISGSGSTT

SEQ ID NO: 1560 - protein, 8 aa, synthetic construct
ITGSGTST

SEQ ID NO: 1561 - protein, 8 aa, synthetic construct
ISATGGST

SEQ ID NO: 1562 - protein, 8 aa, synthetic construct
ISGSGVTT

SEQ ID NO: 1563 - protein, 8 aa, synthetic construct
ISASGANT

SEQ ID NO: 1564 - protein, 8 aa, synthetic construct
ITSSGGST

SEQ ID NO: 1565 - protein, 8 aa, synthetic construct
ISGSGGST

SEQ ID NO: 1566 - protein, 8 aa, synthetic construct
VSGTGGTT

SEQ ID NO: 1567 - protein, 8 aa, synthetic construct
ISGSGYST

SEQ ID NO: 1568 - protein, 8 aa, synthetic construct
ISGGGSNT

SEQ ID NO: 1569 - protein, 8 aa, synthetic construct
ISSSGGNT

SEQ ID NO: 1570 - protein, 8 aa, synthetic construct
ISGSGGRT

SEQ ID NO: 1571 - protein, 8 aa, synthetic construct
ISGSGGSA

SEQ ID NO: 1572 - protein, 8 aa, synthetic construct
ISGSGGRT

SEQ ID NO: 1573 - protein, 8 aa, synthetic construct
ISSGGGGT

SEQ ID NO: 1574 - protein, 8 aa, synthetic construct
ISGSGGST

SEQ ID NO: 1575 - protein, 8 aa, synthetic construct
ISGGGGGT

SEQ ID NO: 1576 - protein, 8 aa, synthetic construct
ISGSGGTT

SEQ ID NO: 1577 - protein, 8 aa, synthetic construct
ISGSGGRT

SEQ ID NO: 1578 - protein, 8 aa, synthetic construct
ISGRDTST

SEQ ID NO: 1579 - protein, 8 aa, synthetic construct
ISGSGGST

SEQ ID NO: 1580 - protein, 8 aa, synthetic construct
ISGSSGRT

SEQ ID NO: 1581 - protein, 8 aa, synthetic construct
ISGSGETT

SEQ ID NO: 1582 - protein, 8 aa, synthetic construct
ISGRGGNT

SEQ ID NO: 1583 - protein, 8 aa, synthetic construct
ISASGGST

SEQ ID NO: 1584 - protein, 8 aa, synthetic construct
ISGSGART

SEQ ID NO: 1585 - protein, 8 aa, synthetic construct
VSGSGGTT

SEQ ID NO: 1586 - protein, 8 aa, synthetic construct
ISGSGDTT

SEQ ID NO: 1587 - protein, 8 aa, synthetic construct
IGGSGDNT

SEQ ID NO: 1588 - protein, 8 aa, synthetic construct
ISGSGGNT

SEQ ID NO: 1589 - protein, 8 aa, synthetic construct
ISGSGGTT

SEQ ID NO: 1590 - protein, 8 aa, synthetic construct
ISGSGRNT

SEQ ID NO: 1591 - protein, 8 aa, synthetic construct
ISGSAVST

SEQ ID NO: 1592 - protein, 8 aa, synthetic construct
VSGSGGRT

SEQ ID NO: 1593 - protein, 8 aa, synthetic construct
ISGSGGST

SEQ ID NO: 1594 - protein, 8 aa, synthetic construct
ISGSGART

SEQ ID NO: 1595 - protein, 7 aa, synthetic construct
ISGRGSV

SEQ ID NO: 1596 - protein, 8 aa, synthetic construct
ISGSGGRT

SEQ ID NO: 1597 - protein, 8 aa, synthetic construct
LSGSGGRT

SEQ ID NO: 1598 - protein, 8 aa, synthetic construct
ISTSGGST

SEQ ID NO: 1599 - protein, 8 aa, synthetic construct
ISGSGART

SEQ ID NO: 1600 - protein, 8 aa, synthetic construct
ISGSGTTT

SEQ ID NO: 1601 - protein, 8 aa, synthetic construct
ISGRDTST

SEQ ID NO: 1602 - protein, 8 aa, synthetic construct
ITASGGST

SEQ ID NO: 1603 - protein, 8 aa, synthetic construct
ISAGGGNT

SEQ ID NO: 1604 - protein, 8 aa, synthetic construct
ISGGGAGT

SEQ ID NO: 1605 - protein, 8 aa, synthetic construct
ISGRGGST

SEQ ID NO: 1606 - protein, 8 aa, synthetic construct
ISRSGGNT

SEQ ID NO: 1607 - protein, 8 aa, synthetic construct
ISGSGTTT

SEQ ID NO: 1608 - protein, 8 aa, synthetic construct
ISGRDTST

SEQ ID NO: 1609 - protein, 8 aa, synthetic construct
ITGSGGST

SEQ ID NO: 1610 - protein, 8 aa, synthetic construct
ISGRGGST

SEQ ID NO: 1611 - protein, 8 aa, synthetic construct
ISGSGTST

SEQ ID NO: 1612 - protein, 8 aa, synthetic construct
ISRSGGNT

SEQ ID NO: 1613 - protein, 8 aa, synthetic construct
ISGSGSRT

SEQ ID NO: 1614 - protein, 8 aa, synthetic construct
ISGSGGNT

SEQ ID NO: 1615 - protein, 8 aa, synthetic construct
ISGSGGYT

SEQ ID NO: 1616 - protein, 8 aa, synthetic construct
VSGSGGST

SEQ ID NO: 1617 - protein, 8 aa, synthetic construct
ISASGGRT

SEQ ID NO: 1618 - protein, 8 aa, synthetic construct
ISGSGSGT

SEQ ID NO: 1619 - protein, 8 aa, synthetic construct
ISRSGDRT

SEQ ID NO: 1620 - protein, 8 aa, synthetic construct
ISASGGTT

SEQ ID NO: 1621 - protein, 8 aa, synthetic construct
ISGSGVTT

SEQ ID NO: 1622 - protein, 8 aa, synthetic construct
ISGSGGSI

SEQ ID NO: 1623 - protein, 8 aa, synthetic construct
ISGRGGST

SEQ ID NO: 1624 - protein, 8 aa, synthetic construct
ISGGGGTT

SEQ ID NO: 1625 - protein, 8 aa, synthetic construct
ISASGGRT

SEQ ID NO: 1626 - protein, 8 aa, synthetic construct
ISPSGGST

SEQ ID NO: 1627 - protein, 8 aa, synthetic construct
ISGSGDVT

SEQ ID NO: 1628 - protein, 8 aa, synthetic construct
ITGSGTST

SEQ ID NO: 1629 - protein, 8 aa, synthetic construct
ITGSGGNT

SEQ ID NO: 1630 - protein, 8 aa, synthetic construct
ISASGGSP

SEQ ID NO: 1631 - protein, 8 aa, synthetic construct
ISGGGGRT

SEQ ID NO: 1632 - protein, 8 aa, synthetic construct
ISGSGRST

SEQ ID NO: 1633 - protein, 8 aa, synthetic construct
ISGSGGRT

SEQ ID NO: 1634 - protein, 8 aa, synthetic construct
ISGSGSST

SEQ ID NO: 1635 - protein, 8 aa, synthetic construct
ISGSGGST

SEQ ID NO: 1636 - protein, 8 aa, synthetic construct
ITGSGGST

SEQ ID NO: 1637 - protein, 8 aa, synthetic construct
ISSTGGTT

SEQ ID NO: 1638 - protein, 8 aa, synthetic construct
ISGSGGTT

SEQ ID NO: 1639 - protein, 8 aa, synthetic construct
ISGGRVST

SEQ ID NO: 1640 - protein, 8 aa, synthetic construct
IRGSGGST

SEQ ID NO: 1641 - protein, 8 aa, synthetic construct
ISVSGGNT

SEQ ID NO: 1642 - protein, 8 aa, synthetic construct
ISGSGAGT

SEQ ID NO: 1643 - protein, 8 aa, synthetic construct
ISSSRGST

SEQ ID NO: 1644 - protein, 6 aa, synthetic construct
ISGRRT

SEQ ID NO: 1645 - protein, 8 aa, synthetic construct
ISGGGGTT

SEQ ID NO: 1646 - protein, 8 aa, synthetic construct
ISASGANT

SEQ ID NO: 1647 - protein, 8 aa, synthetic construct
ISGSGVTT

SEQ ID NO: 1648 - protein, 8 aa, synthetic construct
ISGSGSTT

SEQ ID NO: 1649 - protein, 8 aa, synthetic construct
ISGSGRNT

SEQ ID NO: 1650 - protein, 8 aa, synthetic construct
ISGRDTST

SEQ ID NO: 1651 - protein, 8 aa, synthetic construct
ISGTGSST

SEQ ID NO: 1652 - protein, 6 aa, synthetic construct
SRSGTG

SEQ ID NO: 1653 - protein, 6 aa, synthetic construct
NWSGGS

SEQ ID NO: 1654 - protein, 6 aa, synthetic construct
SRTGSS

SEQ ID NO: 1655 - protein, 5 aa, synthetic construct
SARGM

SEQ ID NO: 1656 - protein, 6 aa, synthetic construct
NWNGGS

SEQ ID NO: 1657 - protein, 5 aa, synthetic construct
LSGGS

SEQ ID NO: 1658 - protein, 6 aa, synthetic construct
NWSGAR

SEQ ID NO: 1659 - protein, 5 aa, synthetic construct
LRGGS

SEQ ID NO: 1660 - protein, 6 aa, synthetic construct
SRTGSS

SEQ ID NO: 1661 - protein, 6 aa, synthetic construct
SWSTGS

SEQ ID NO: 1662 - protein, 6 aa, synthetic construct
SWSAGS

SEQ ID NO: 1663 - protein, 7 aa, synthetic construct
YGTGGEL

SEQ ID NO: 1664 - protein, 6 aa, synthetic construct
TWNGTR

SEQ ID NO: 1665 - protein, 6 aa, synthetic construct
SWSGGS

SEQ ID NO: 1666 - protein, 6 aa, synthetic construct
SRGGSA

SEQ ID NO: 1667 - protein, 5 aa, synthetic construct
TRLGV

SEQ ID NO: 1668 - protein, 6 aa, synthetic construct
SRDGAA

SEQ ID NO: 1669 - protein, 6 aa, synthetic construct
SWSLSR

SEQ ID NO: 1670 - protein, 6 aa, synthetic construct
RWSGGI

SEQ ID NO: 1671 - protein, 6 aa, synthetic construct
NWSGAS

SEQ ID NO: 1672 - protein, 6 aa, synthetic construct
NSGGSY

SEQ ID NO: 1673 - protein, 6 aa, synthetic construct
SGSGVY

SEQ ID NO: 1674 - protein, 6 aa, synthetic construct
SRDGAA

SEQ ID NO: 1675 - protein, 6 aa, synthetic construct
SWSLSR

SEQ ID NO: 1676 - protein, 6 aa, synthetic construct
SWSLTR

SEQ ID NO: 1677 - protein, 6 aa, synthetic construct
SGSGDD

SEQ ID NO: 1678 - protein, 5 aa, synthetic construct
SASGS

SEQ ID NO: 1679 - protein, 6 aa, synthetic construct
NWSGAR

SEQ ID NO: 1680 - protein, 5 aa, synthetic construct
GTRGA

SEQ ID NO: 1681 - protein, 5 aa, synthetic construct
TRLGV

SEQ ID NO: 1682 - protein, 5 aa, synthetic construct
GWYGS

SEQ ID NO: 1683 - protein, 6 aa, synthetic construct
SWSGGR

SEQ ID NO: 1684 - protein, 6 aa, synthetic construct
DWSGSR

SEQ ID NO: 1685 - protein, 6 aa, synthetic construct
DWSGSR

SEQ ID NO: 1686 - protein, 6 aa, synthetic construct
NWNGDS

SEQ ID NO: 1687 - protein, 5 aa, synthetic construct
TSGGS

SEQ ID NO: 1688 - protein, 6 aa, synthetic construct
NSGGSY

SEQ ID NO: 1689 - protein, 6 aa, synthetic construct
SGRSGN

SEQ ID NO: 1690 - protein, 6 aa, synthetic construct
SRSGGS

SEQ ID NO: 1691 - protein, 5 aa, synthetic construct
HTGGG

SEQ ID NO: 1692 - protein, 5 aa, synthetic construct
SSGGR

SEQ ID NO: 1693 - protein, 6 aa, synthetic construct
NSGGSS

SEQ ID NO: 1694 - protein, 6 aa, synthetic construct
SWSLTR

SEQ ID NO: 1695 - protein, 6 aa, synthetic construct
TWGGST

SEQ ID NO: 1696 - protein, 6 aa, synthetic construct
NWGGGS

SEQ ID NO: 1697 - protein, 5 aa, synthetic construct
SIGGR

SEQ ID NO: 1698 - protein, 5 aa, synthetic construct
RSSGG

SEQ ID NO: 1699 - protein, 9 aa, synthetic construct
YSGVRSGVS

SEQ ID NO: 1700 - protein, 7 aa, synthetic construct
YGTGGEL

SEQ ID NO: 1701 - protein, 6 aa, synthetic construct
TFSGAR

SEQ ID NO: 1702 - protein, 4 aa, synthetic construct
RSGA

SEQ ID NO: 1703 - protein, 6 aa, synthetic construct
KFSGGT

SEQ ID NO: 1704 - protein, 6 aa, synthetic construct
SWRGGS

SEQ ID NO: 1705 - protein, 6 aa, synthetic construct
SWALSR

SEQ ID NO: 1706 - protein, 6 aa, synthetic construct
SWTGGS

SEQ ID NO: 1707 - protein, 6 aa, synthetic construct
SWSGGS

SEQ ID NO: 1708 - protein, 6 aa, synthetic construct
NWSGAR

SEQ ID NO: 1709 - protein, 6 aa, synthetic construct
SADGSD

SEQ ID NO: 1710 - protein, 6 aa, synthetic construct
RWGTTD

SEQ ID NO: 1711 - protein, 6 aa, synthetic construct
KPSGDT

SEQ ID NO: 1712 - protein, 6 aa, synthetic construct
SMSGAN

SEQ ID NO: 1713 - protein, 6 aa, synthetic construct
NWSGGN

SEQ ID NO: 1714 - protein, 6 aa, synthetic construct
SRTGSS

SEQ ID NO: 1715 - protein, 7 aa, synthetic construct
TWNGGTH

SEQ ID NO: 1716 - protein, 6 aa, synthetic construct
NWNGDS

SEQ ID NO: 1717 - protein, 6 aa, synthetic construct
SRSGTG

SEQ ID NO: 1718 - protein, 5 aa, synthetic construct
VNGGS

SEQ ID NO: 1719 - protein, 6 aa, synthetic construct
SWDGGN

SEQ ID NO: 1720 - protein, 6 aa, synthetic construct
SWRGGN

SEQ ID NO: 1721 - protein, 5 aa, synthetic construct
LSGGS

SEQ ID NO: 1722 - protein, 6 aa, synthetic construct
HWSGGS

SEQ ID NO: 1723 - protein, 5 aa, synthetic construct
TPRGL

SEQ ID NO: 1724 - protein, 6 aa, synthetic construct
IWRGGS

SEQ ID NO: 1725 - protein, 6 aa, synthetic construct
SWSGSA

SEQ ID NO: 1726 - protein, 5 aa, synthetic construct
LRGGS

SEQ ID NO: 1727 - protein, 6 aa, synthetic construct
SWSLTR

SEQ ID NO: 1728 - protein, 6 aa, synthetic construct
RIKDGS

SEQ ID NO: 1729 - protein, 6 aa, synthetic construct
SRSGTL

SEQ ID NO: 1730 - protein, 5 aa, synthetic construct
NVGGG

SEQ ID NO: 1731 - protein, 6 aa, synthetic construct
SRSGGT

SEQ ID NO: 1732 - protein, 4 aa, synthetic construct
SYSG

SEQ ID NO: 1733 - protein, 6 aa, synthetic construct
STSGTR

SEQ ID NO: 1734 - protein, 5 aa, synthetic construct
GTSGP

SEQ ID NO: 1735 - protein, 6 aa, synthetic construct
SWGGGL

SEQ ID NO: 1736 - protein, 6 aa, synthetic construct
SWTAGT

SEQ ID NO: 1737 - protein, 6 aa, synthetic construct
NTGGGS

SEQ ID NO: 1738 - protein, 6 aa, synthetic construct
SWSSGN

SEQ ID NO: 1739 - protein, 5 aa, synthetic construct
GTHGT

SEQ ID NO: 1740 - protein, 4 aa, synthetic construct
SRSG

SEQ ID NO: 1741 - protein, 6 aa, synthetic construct
TWSGDM

SEQ ID NO: 1742 - protein, 5 aa, synthetic construct
NTAGW

SEQ ID NO: 1743 - protein, 6 aa, synthetic construct
SWSGGK

SEQ ID NO: 1744 - protein, 4 aa, synthetic construct
HTGG

SEQ ID NO: 1745 - protein, 6 aa, synthetic construct
SWSGGT

SEQ ID NO: 1746 - protein, 6 aa, synthetic construct
NRSGKS

SEQ ID NO: 1747 - protein, 19 aa, synthetic construct
APRPKRVSVSYFSTASNYD

SEQ ID NO: 1748 - protein, 15 aa, synthetic construct
EGGYSGTYYYTGDFD

SEQ ID NO: 1749 - protein, 15 aa, synthetic construct
GNGGRQYGHSRARYD

SEQ ID NO: 1750 - protein, 15 aa, synthetic construct
GNGGRKYGHHRARYD

SEQ ID NO: 1751 - protein, 15 aa, synthetic construct
GNGGSRYGHSRARYD

SEQ ID NO: 1752 - protein, 15 aa, synthetic construct
GNGGRYYNHSRTRYE

SEQ ID NO: 1753 - protein, 19 aa, synthetic construct
APRPKRVSVRYFNTSSNYD

SEQ ID NO: 1754 - protein, 19 aa, synthetic construct
APRPKRVSFSYFSTSSNYE

SEQ ID NO: 1755 - protein, 19 aa, synthetic construct
APRPKRISVQYFTTSSNYD

SEQ ID NO: 1756 - protein, 19 aa, synthetic construct
APRPKRVSVRYFSTSSNYD

SEQ ID NO: 1757 - protein, 15 aa, synthetic construct
GNGGRAYGYSRARYE

SEQ ID NO: 1758 - protein, 15 aa, synthetic construct
GNGGRHYGHSRARYD

SEQ ID NO: 1759 - protein, 19 aa, synthetic construct
APRPNRVSVRYFSTNNNYD

SEQ ID NO: 1760 - protein, 15 aa, synthetic construct
GNGGRNYGHSRSRYE

SEQ ID NO: 1761 - protein, 15 aa, synthetic construct
GNRRRPYGYSHSRYD

SEQ ID NO: 1762 - protein, 19 aa, synthetic construct
APRPKRVSVSYFSTASNYD

SEQ ID NO: 1763 - protein, 15 aa, synthetic construct
GNGGRHYGHNRPRYD

SEQ ID NO: 1764 - protein, 15 aa, synthetic construct
EGGYRGTYYYTGDFD

SEQ ID NO: 1765 - protein, 15 aa, synthetic construct
GNGGRKYGHHRARYD

SEQ ID NO: 1766 - protein, 15 aa, synthetic construct
GNGGRTYGHSRARYE

SEQ ID NO: 1767 - protein, 15 aa, synthetic construct
GNGGRHYGHSRARYD

SEQ ID NO: 1768 - protein, 15 aa, synthetic construct
GNGGRLYGHSRARYD

SEQ ID NO: 1769 - protein, 15 aa, synthetic construct
GNGGRAYGYSRARYE

SEQ ID NO: 1770 - protein, 19 aa, synthetic construct
APRPKRVSVRYFSTSSNYD

SEQ ID NO: 1771 - protein, 15 aa, synthetic construct
GNGGRTYGHSRARYD

SEQ ID NO: 1772 - protein, 15 aa, synthetic construct
GNGGRAYGYSRARYE

SEQ ID NO: 1773 - protein, 15 aa, synthetic construct
GNGGRKYGHHRARYD

SEQ ID NO: 1774 - protein, 15 aa, synthetic construct
GNGGRQYGHSRARYD

SEQ ID NO: 1775 - protein, 15 aa, synthetic construct
GNGGRTYGHSRARYD

SEQ ID NO: 1776 - protein, 15 aa, synthetic construct
GNGGRHYGHSRARYD

SEQ ID NO: 1777 - protein, 15 aa, synthetic construct
GNGGRNYGHSRARYE

SEQ ID NO: 1778 - protein, 15 aa, synthetic construct
GNGGRTYGHSRARYE

SEQ ID NO: 1779 - protein, 15 aa, synthetic construct
GNGGRNYGHSRARYE

SEQ ID NO: 1780 - protein, 15 aa, synthetic construct
GNGGRTYGHSRARYE

SEQ ID NO: 1781 - protein, 15 aa, synthetic construct
GNGGRSYGHSRARYD

SEQ ID NO: 1782 - protein, 15 aa, synthetic construct
GNGGRLYGHSRARYD

SEQ ID NO: 1783 - protein, 15 aa, synthetic construct
GNGGRHYGHSRARYD

SEQ ID NO: 1784 - protein, 15 aa, synthetic construct
GNGGRTYGHSRARYD

SEQ ID NO: 1785 - protein, 15 aa, synthetic construct
GNGGRLYGHSRARYD

SEQ ID NO: 1786 - protein, 19 aa, synthetic construct
APRPKRVSVRYFSTSSNYD

SEQ ID NO: 1787 - protein, 15 aa, synthetic construct
GNGGRQYGHSRARYD

SEQ ID NO: 1788 - protein, 15 aa, synthetic construct
GNGGRTYGHSRARYD

SEQ ID NO: 1789 - protein, 15 aa, synthetic construct
GNGGRLYGHSRARYD

SEQ ID NO: 1790 - protein, 19 aa, synthetic construct
APRPKRVSVSYFSTASNYD

SEQ ID NO: 1791 - protein, 15 aa, synthetic construct
GNGGRTYGHSRARYE

SEQ ID NO: 1792 - protein, 15 aa, synthetic construct
GNGGRTYGHSRARYE

SEQ ID NO: 1793 - protein, 15 aa, synthetic construct
GNGGRAYGYSRARYE

SEQ ID NO: 1794 - protein, 15 aa, synthetic construct
GNGGRAYGYSRARYE

SEQ ID NO: 1795 - protein, 15 aa, synthetic construct
GNGGRQYGHSRARYD

SEQ ID NO: 1796 - protein, 19 aa, synthetic construct
APRPKRVSVQYFSTSSNYD

SEQ ID NO: 1797 - protein, 15 aa, synthetic construct
GNGGRSYGHSRARYD

SEQ ID NO: 1798 - protein, 15 aa, synthetic construct
GNGGRTYGHSRARYD

SEQ ID NO: 1799 - protein, 15 aa, synthetic construct
GNGGRYYGHSRARYD

SEQ ID NO: 1800 - protein, 15 aa, synthetic construct
GNGGRQYGHSRARYD

SEQ ID NO: 1801 - protein, 15 aa, synthetic construct
GNGGRSYGHSRARYD

SEQ ID NO: 1802 - protein, 15 aa, synthetic construct
GNGGRQYGHSRARYD

SEQ ID NO: 1803 - protein, 15 aa, synthetic construct
GNGGRTYGHSRARYE

SEQ ID NO: 1804 - protein, 15 aa, synthetic construct
GNGGRTYGHSRARYE

SEQ ID NO: 1805 - protein, 19 aa, synthetic construct
APRPKYVSVSYFSTSSNYD

SEQ ID NO: 1806 - protein, 15 aa, synthetic construct
GNGGRLYGHSRARYD

SEQ ID NO: 1807 - protein, 15 aa, synthetic construct
GNGGRTYGHSRARYE

SEQ ID NO: 1808 - protein, 15 aa, synthetic construct
GNGGRTYGHSRARYE

SEQ ID NO: 1809 - protein, 15 aa, synthetic construct
GNGGRTYGHSRARYE

SEQ ID NO: 1810 - protein, 15 aa, synthetic construct
GNGGRAYGYSRARYE

SEQ ID NO: 1811 - protein, 15 aa, synthetic construct
GNGGRQYGHSRARYD

SEQ ID NO: 1812 - protein, 15 aa, synthetic construct
GNGGRYYGHSRARYD

SEQ ID NO: 1813 - protein, 15 aa, synthetic construct
GNGGRLYGHSRARYD

SEQ ID NO: 1814 - protein, 15 aa, synthetic construct
GNGGRQYGHSRARYD

SEQ ID NO: 1815 - protein, 19 aa, synthetic construct
APRPKRVSVSYFYTSSNYD

SEQ ID NO: 1816 - protein, 15 aa, synthetic construct
GNGGRAYGYSRARYE

SEQ ID NO: 1817 - protein, 15 aa, synthetic construct
GNGGRQYGHSRARYD

SEQ ID NO: 1818 - protein, 15 aa, synthetic construct
GNGGRQYGHSRARYD

SEQ ID NO: 1819 - protein, 15 aa, synthetic construct
GNGGRQYGHSRARYD

SEQ ID NO: 1820 - protein, 15 aa, synthetic construct
GNGGRSYGHSRARYD

SEQ ID NO: 1821 - protein, 15 aa, synthetic construct
GNGGRQYGHSRARYD

SEQ ID NO: 1822 - protein, 15 aa, synthetic construct
GNGGRHYGHSRARYD

SEQ ID NO: 1823 - protein, 15 aa, synthetic construct
GNGGRSYGHSRARYD

SEQ ID NO: 1824 - protein, 15 aa, synthetic construct
GNGGRQYGHSRARYD

SEQ ID NO: 1825 - protein, 15 aa, synthetic construct
GNGGRAYGYSRARYE

SEQ ID NO: 1826 - protein, 15 aa, synthetic construct
GNGGRHYGHSRARYD

SEQ ID NO: 1827 - protein, 15 aa, synthetic construct
GNGGRNYGHSRARYD

SEQ ID NO: 1828 - protein, 15 aa, synthetic construct
GNGGRHYGHSRARYD

SEQ ID NO: 1829 - protein, 15 aa, synthetic construct
GNGGRTYGHSRARYE

SEQ ID NO: 1830 - protein, 15 aa, synthetic construct
GNGGRQYGHSRARYD

SEQ ID NO: 1831 - protein, 15 aa, synthetic construct
GNGGRAYGYSRARYE

SEQ ID NO: 1832 - protein, 15 aa, synthetic construct
GNGGRQYGHSRARYD

SEQ ID NO: 1833 - protein, 19 aa, synthetic construct
APRPKRVSVSYFYTSSNYD

SEQ ID NO: 1834 - protein, 19 aa, synthetic construct
APRPKRVSVQYFSTSSNYD

SEQ ID NO: 1835 - protein, 15 aa, synthetic construct
GNGGRQYGHSRARYD

SEQ ID NO: 1836 - protein, 19 aa, synthetic construct
APRPKRISVSYFSTSSNYD

SEQ ID NO: 1837 - protein, 19 aa, synthetic construct
APRPKRVSFSYFSTSSNYE

SEQ ID NO: 1838 - protein, 15 aa, synthetic construct
GNGGRQYGHSRARYD

SEQ ID NO: 1839 - protein, 19 aa, synthetic construct
APRPKRVSVQYFSTSSNYD

SEQ ID NO: 1840 - protein, 15 aa, synthetic construct
GNGGRTYGHSRARYE

SEQ ID NO: 1841 - protein, 19 aa, synthetic construct
APRPKRVSVSYFSTASNYD

SEQ ID NO: 1842 - protein, 15 aa, synthetic construct
GNGGRTYGHSRARYE

SEQ ID NO: 1843 - protein, 15 aa, synthetic construct
GNGGRQYGHSRARYD

SEQ ID NO: 1844 - protein, 19 aa, synthetic construct
APRPKRVSVSYFSTASNYD

SEQ ID NO: 1845 - protein, 15 aa, synthetic construct
GNGGRSYGHSRARYD

SEQ ID NO: 1846 - protein, 15 aa, synthetic construct
GNGGRTYGHSRARYE

SEQ ID NO: 1847 - protein, 15 aa, synthetic construct
GNGGRQYGHSRARYD

SEQ ID NO: 1848 - protein, 15 aa, synthetic construct
GNGGRSYGHSRARYD

SEQ ID NO: 1849 - protein, 15 aa, synthetic construct
GNGGRQYGHSRARYD

SEQ ID NO: 1850 - protein, 15 aa, synthetic construct
GNGGRQYGHSRARYD

SEQ ID NO: 1851 - protein, 15 aa, synthetic construct
GNGGRHYGHSRARYD

SEQ ID NO: 1852 - protein, 15 aa, synthetic construct
GNGGRHYGHSRARYD

SEQ ID NO: 1853 - protein, 15 aa, synthetic construct
GNGGRQYGHSRARYD

SEQ ID NO: 1854 - protein, 15 aa, synthetic construct
GNGGRNYGHSRARYE

SEQ ID NO: 1855 - protein, 15 aa, synthetic construct
GNGGRKYGHHRARYD

SEQ ID NO: 1856 - protein, 15 aa, synthetic construct
GNGGRQYGHSRARYD

SEQ ID NO: 1857 - protein, 15 aa, synthetic construct
GNGGRQYGHSRARYD

SEQ ID NO: 1858 - protein, 15 aa, synthetic construct
GNGGRKYGHHRARYD

SEQ ID NO: 1859 - protein, 15 aa, synthetic construct
GNGGRQYGHSRARYD

SEQ ID NO: 1860 - protein, 17 aa, synthetic construct
AKQIPGRKWTANGRKDY

SEQ ID NO: 1861 - protein, 9 aa, synthetic construct
AKYPKNFDY

SEQ ID NO: 1862 - protein, 12 aa, synthetic construct
ARLPKRGPRFDY

SEQ ID NO: 1863 - protein, 17 aa, synthetic construct
AKGIRGWIGHDTQPFDY

SEQ ID NO: 1864 - protein, 9 aa, synthetic construct
AKYPKNFDY

SEQ ID NO: 1865 - protein, 12 aa, synthetic construct
AKLQKRGPRFDY

SEQ ID NO: 1866 - protein, 12 aa, synthetic construct
VKAPLRSGGVDY

SEQ ID NO: 1867 - protein, 12 aa, synthetic construct
AKFPSTHGKFDY

SEQ ID NO: 1868 - protein, 12 aa, synthetic construct
ARVIAAAGAFDY

SEQ ID NO: 1869 - protein, 10 aa, synthetic construct
AKRTRSKFDY

SEQ ID NO: 1870 - protein, 13 aa, synthetic construct
AKRTENRGVSFDY

SEQ ID NO: 1871 - protein, 9 aa, synthetic construct
AKGWRRFDY

SEQ ID NO: 1872 - protein, 8 aa, synthetic construct
AKYTWNGY

SEQ ID NO: 1873 - protein, 7 aa, synthetic construct
ASLSRGY

SEQ ID NO: 1874 - protein, 10 aa, synthetic construct
AKFRGRGFDY

SEQ ID NO: 1875 - protein, 9 aa, synthetic construct
AKAHNAFDY

SEQ ID NO: 1876 - protein, 8 aa, synthetic construct
ARGNYFDY

SEQ ID NO: 1877 - protein, 10 aa, synthetic construct
AKFRGRGFDY

SEQ ID NO: 1878 - protein, 15 aa, synthetic construct
AKDKRYRGSQHYFDY

SEQ ID NO: 1879 - protein, 9 aa, synthetic construct
AKAGRKFDY

SEQ ID NO: 1880 - protein, 12 aa, synthetic construct
AKQSGSEDHFDY

SEQ ID NO: 1881 - protein, 15 aa, synthetic construct
AKWRREGYTGSKFDY

SEQ ID NO: 1882 - protein, 11 aa, synthetic construct
AKSRTGRYFDY

SEQ ID NO: 1883 - protein, 9 aa, synthetic construct
AKGYRHFDY

SEQ ID NO: 1884 - protein, 10 aa, synthetic construct
AKDLGQGFDY

SEQ ID NO: 1885 - protein, 10 aa, synthetic construct
AKRTRSKFDY

SEQ ID NO: 1886 - protein, 12 aa, synthetic construct
AGLPKRGPRFDY

SEQ ID NO: 1887 - protein, 12 aa, synthetic construct
ARLPKRGPWFDY

SEQ ID NO: 1888 - protein, 9 aa, synthetic construct
AKPSRRFDY

SEQ ID NO: 1889 - protein, 10 aa, synthetic construct
ARSGPYYFDY

SEQ ID NO: 1890 - protein, 9 aa, synthetic construct
AKPGHRFDY

SEQ ID NO: 1891 - protein, 14 aa, synthetic construct
AKDRYSQVHYALDY

SEQ ID NO: 1892 - protein, 14 aa, synthetic construct
ARHRAGSSGWYSDY

SEQ ID NO: 1893 - protein, 13 aa, synthetic construct
AKRTENRGVSFDY

SEQ ID NO: 1894 - protein, 10 aa, synthetic construct
AKVTGRGFDY

SEQ ID NO: 1895 - protein, 10 aa, synthetic construct
AKGPGTRGDY

SEQ ID NO: 1896 - protein, 11 aa, synthetic construct
ARYGAYFGLDY

SEQ ID NO: 1897 - protein, 16 aa, synthetic construct
AKKDYDYVWGSPYFDY

SEQ ID NO: 1898 - protein, 14 aa, synthetic construct
ARIRVGPSGGAFDY

SEQ ID NO: 1899 - protein, 12 aa, synthetic construct
AKFPSSQFRFDY

SEQ ID NO: 1900 - protein, 9 aa, synthetic construct
AKYPKNFNY

SEQ ID NO: 1901 - protein, 15 aa, synthetic construct
AKDKRYRGSQHYFDY

SEQ ID NO: 1902 - protein, 10 aa, synthetic construct
AREGLWAFDY

SEQ ID NO: 1903 - protein, 14 aa, synthetic construct
GRHRAGSIGWYSDY

SEQ ID NO: 1904 - protein, 10 aa, synthetic construct
AKRTRSKFDY

SEQ ID NO: 1905 - protein, 9 aa, synthetic construct
AKGRRRFDY

SEQ ID NO: 1906 - protein, 12 aa, synthetic construct
AKLQKRGPRFDY

SEQ ID NO: 1907 - protein, 10 aa, synthetic construct
AHLPGRGFEY

SEQ ID NO: 1908 - protein, 9 aa, synthetic construct
AKGFRIFDY

SEQ ID NO: 1909 - protein, 9 aa, synthetic construct
AKGARRFDY

SEQ ID NO: 1910 - protein, 9 aa, synthetic construct
AKSLGRFDY

SEQ ID NO: 1911 - protein, 12 aa, synthetic construct
ARLPKRGPRFDY

SEQ ID NO: 1912 - protein, 13 aa, synthetic construct
AKSGTRIKQGFDY

SEQ ID NO: 1913 - protein, 12 aa, synthetic construct
ARLPKRGPRFDY

SEQ ID NO: 1914 - protein, 9 aa, synthetic construct
AKNRAKFDY

SEQ ID NO: 1915 - protein, 12 aa, synthetic construct
AKLPKRGPRFDY

SEQ ID NO: 1916 - protein, 10 aa, synthetic construct
AKFRGRGFDY

SEQ ID NO: 1917 - protein, 10 aa, synthetic construct
AKGVRKGFDY

SEQ ID NO: 1918 - protein, 10 aa, synthetic construct
ARGYRGYFDY

SEQ ID NO: 1919 - protein, 9 aa, synthetic construct
AKSNGRFDY

SEQ ID NO: 1920 - protein, 10 aa, synthetic construct
AKYFHGKFDY

SEQ ID NO: 1921 - protein, 10 aa, synthetic construct
AKGRWSIFDY

SEQ ID NO: 1922 - protein, 10 aa, synthetic construct
AKGPGTRGDY

SEQ ID NO: 1923 - protein, 10 aa, synthetic construct
AKWSSRAFDY

SEQ ID NO: 1924 - protein, 12 aa, synthetic construct
ARLPKRGPRFDY

SEQ ID NO: 1925 - protein, 12 aa, synthetic construct
ARLPKRGPRFDY

SEQ ID NO: 1926 - protein, 9 aa, synthetic construct
AKYPKNFDY

SEQ ID NO: 1927 - protein, 12 aa, synthetic construct
ARLPKRGPRFDY

SEQ ID NO: 1928 - protein, 13 aa, synthetic construct
AKRTENRGVSFDY

SEQ ID NO: 1929 - protein, 10 aa, synthetic construct
AKFRGRGFDY

SEQ ID NO: 1930 - protein, 12 aa, synthetic construct
ARLPKRGPRFDY

SEQ ID NO: 1931 - protein, 11 aa, synthetic construct
ATAESDDTYDY

SEQ ID NO: 1932 - protein, 12 aa, synthetic construct
ARLPKRGPRFDY

SEQ ID NO: 1933 - protein, 12 aa, synthetic construct
ARLPKRGPRFDY

SEQ ID NO: 1934 - protein, 10 aa, synthetic construct
AKFRGRGFDY

SEQ ID NO: 1935 - protein, 15 aa, synthetic construct
AKDKRYRGSQHYFDY

SEQ ID NO: 1936 - protein, 10 aa, synthetic construct
AKRTRSKFDY

SEQ ID NO: 1937 - protein, 9 aa, synthetic construct
AKAGSGFDY

SEQ ID NO: 1938 - protein, 11 aa, synthetic construct
AESFRSRYFDY

SEQ ID NO: 1939 - protein, 7 aa, synthetic construct
ASLSRGY

SEQ ID NO: 1940 - protein, 12 aa, synthetic construct
AKLPKRGPRFDY

SEQ ID NO: 1941 - protein, 13 aa, synthetic construct
AKRTENRGVSFDY

SEQ ID NO: 1942 - protein, 9 aa, synthetic construct
ARWTSGLDY

SEQ ID NO: 1943 - protein, 9 aa, synthetic construct
AKGLRRFDY

SEQ ID NO: 1944 - protein, 10 aa, synthetic construct
AKFRGRGFDY

SEQ ID NO: 1945 - protein, 12 aa, synthetic construct
ARLPKRGPRFDY

SEQ ID NO: 1946 - protein, 9 aa, synthetic construct
AKGRRIFDY

SEQ ID NO: 1947 - protein, 11 aa, synthetic construct
ARGGDYGSGDY

SEQ ID NO: 1948 - protein, 12 aa, synthetic construct
ARPPKRGPRFDY

SEQ ID NO: 1949 - protein, 10 aa, synthetic construct
AKRTRSKFDY

SEQ ID NO: 1950 - protein, 11 aa, synthetic construct
ARGGDYGSGDY

SEQ ID NO: 1951 - protein, 10 aa, synthetic construct
AKRTRSKFDY

SEQ ID NO: 1952 - protein, 12 aa, synthetic construct
ARPPKRGPRFDY

SEQ ID NO: 1953 - protein, 9 aa, synthetic construct
AKGFRIFDY

SEQ ID NO: 1954 - protein, 10 aa, synthetic construct
AKWSSRAFDY

SEQ ID NO: 1955 - protein, 14 aa, synthetic construct
AKHSKSSHRQSFDY

SEQ ID NO: 1956 - protein, 9 aa, synthetic construct
AKLTGRFDY

SEQ ID NO: 1957 - protein, 9 aa, synthetic construct
AKSGAYFDY

SEQ ID NO: 1958 - protein, 10 aa, synthetic construct
AKRTRSKFDY

SEQ ID NO: 1959 - protein, 9 aa, synthetic construct
AKYPKNFDY

SEQ ID NO: 1960 - protein, 10 aa, synthetic construct
AKGVRKKFDY

SEQ ID NO: 1961 - protein, 12 aa, synthetic construct
ARLPKRGPRFDY

SEQ ID NO: 1962 - protein, 13 aa, synthetic construct
AKRTENRGVSFDY

SEQ ID NO: 1963 - protein, 12 aa, synthetic construct
AKYTGRWEPFDY

SEQ ID NO: 1964 - protein, 12 aa, synthetic construct
ARLPKRGPRFDY

SEQ ID NO: 1965 - protein, 12 aa, synthetic construct
ARLPKRGPRFDY

SEQ ID NO: 1966 - protein, 16 aa, synthetic construct
ARRTGREYGGGWYFDY

SEQ ID NO: 1967 - protein, 9 aa, synthetic construct
AKNRAKFDY

SEQ ID NO: 1968 - protein, 12 aa, synthetic construct
ARLPKRGPRFDY

SEQ ID NO: 1969 - protein, 9 aa, synthetic construct
ARGRAGADY

SEQ ID NO: 1970 - protein, 11 aa, synthetic construct
ARDIAAASFDY

SEQ ID NO: 1971 - protein, 12 aa, synthetic construct
AISYHFDYYFDY

SEQ ID NO: 1972 - protein, 17 aa, synthetic construct
ARECSGGSCSYYYGMDV

SEQ ID NO: 1973 - protein, 17 aa, synthetic construct
ARLAVSTSDYYYYGMDV

SEQ ID NO: 1974 - protein, 17 aa, synthetic construct
ARDDRVRFSPVRRWFDP

SEQ ID NO: 1975 - protein, 12 aa, synthetic construct
ARVRSSSWYGDY

SEQ ID NO: 1976 - protein, 12 aa, synthetic construct
ARKTGGHYPFDY

SEQ ID NO: 1977 - protein, 12 aa, synthetic construct
ARDQARYYGMDV

SEQ ID NO: 1978 - protein, 12 aa, synthetic construct
ASGLRARNGFDI

SEQ ID NO: 1979 - protein, 8 aa, synthetic construct
ARGAILAY

SEQ ID NO: 1980 - protein, 11 aa, synthetic construct
ARDVGFGELHP

SEQ ID NO: 1981 - protein, 13 aa, synthetic construct
ARGRTGTLYGMDV

SEQ ID NO: 1982 - protein, 15 aa, synthetic construct
ARVAASGSYYRAFDQ

SEQ ID NO: 1983 - protein, 11 aa, synthetic construct
ARDRGFGWFDP

SEQ ID NO: 1984 - protein, 17 aa, synthetic construct
AKVSYDSSGYYYDAFDI

SEQ ID NO: 1985 - protein, 11 aa, synthetic construct
ARSGSFLSFDS

SEQ ID NO: 1986 - protein, 16 aa, synthetic construct
ARVDYKKKSYYNAMDA

SEQ ID NO: 1987 - protein, 12 aa, synthetic construct
ARGPRGRGAFDV

SEQ ID NO: 1988 - protein, 17 aa, synthetic construct
ARDDRVRFSPVRRWFDP

SEQ ID NO: 1989 - protein, 14 aa, synthetic construct
ARGGHVGIRRPFDV

SEQ ID NO: 1990 - protein, 14 aa, synthetic construct
ARHAHGAGSYPFDY

SEQ ID NO: 1991 - protein, 12 aa, synthetic construct
GRAPRKYYGMDV

SEQ ID NO: 1992 - protein, 15 aa, synthetic construct
ARVPLRGSGRLSFDY

SEQ ID NO: 1993 - protein, 17 aa, synthetic construct
ARAPRSPILGVRRGLDP

SEQ ID NO: 1994 - protein, 10 aa, synthetic construct
VRGGTRGLGY

SEQ ID NO: 1995 - protein, 16 aa, synthetic construct
ARLDHDSSGFYEAFDV

SEQ ID NO: 1996 - protein, 18 aa, synthetic construct
ARGGMRLGKSYYYYGMDV

SEQ ID NO: 1997 - protein, 14 aa, synthetic construct
ARLSVARGAYGMDV

SEQ ID NO: 1998 - protein, 13 aa, synthetic construct
ARRGRPPQYYFDS

SEQ ID NO: 1999 - protein, 11 aa, synthetic construct
ARGWEPGIAAN

SEQ ID NO: 2000 - protein, 13 aa, synthetic construct
ARHQYSGSGSFRY

SEQ ID NO: 2001 - protein, 11 aa, synthetic construct
AKHRGSFWFDP

SEQ ID NO: 2002 - protein, 15 aa, synthetic construct
TTMFGSGTFYTGFDF

SEQ ID NO: 2003 - protein, 12 aa, synthetic construct
ARAGARFVGFDY

SEQ ID NO: 2004 - protein, 10 aa, synthetic construct
ATFNPVGLFY

SEQ ID NO: 2005 - protein, 11 aa, synthetic construct
ARSGSFLSFDS

SEQ ID NO: 2006 - protein, 11 aa, synthetic construct
ARSRNGRWFDP

SEQ ID NO: 2007 - protein, 8 aa, synthetic construct
ARGASFDS

SEQ ID NO: 2008 - protein, 15 aa, synthetic construct
ARGRQRQRSTPLGRY

SEQ ID NO: 2009 - protein, 11 aa, synthetic construct
ARGGDWVAFDY

SEQ ID NO: 2010 - protein, 12 aa, synthetic construct
ARRKGPTYGMDV

SEQ ID NO: 2011 - protein, 15 aa, synthetic construct
ARVTRYQGWLSHFDY

SEQ ID NO: 2012 - protein, 15 aa, synthetic construct
ARVFVSSGWYDGMDV

SEQ ID NO: 2013 - protein, 8 aa, synthetic construct
ARGASLDV

SEQ ID NO: 2014 - protein, 10 aa, synthetic construct
ARAIGGRTAY

SEQ ID NO: 2015 - protein, 15 aa, synthetic construct
ARVPLRGSGRLSFDY

SEQ ID NO: 2016 - protein, 15 aa, synthetic construct
ARVVTAMGYYYGMDV

SEQ ID NO: 2017 - protein, 18 aa, synthetic construct
ARDLGMRGPYYYYYGMDV

SEQ ID NO: 2018 - protein, 10 aa, synthetic construct
VASRNYLLDF

SEQ ID NO: 2019 - protein, 13 aa, synthetic construct
ARGDLTVTRKYDS

SEQ ID NO: 2020 - protein, 11 aa, synthetic construct
ARTYSYGSFDY

SEQ ID NO: 2021 - protein, 10 aa, synthetic construct
ASWRAAPFDY

SEQ ID NO: 2022 - protein, 15 aa, synthetic construct
ARVPLRGSGRLSFDY

SEQ ID NO: 2023 - protein, 9 aa, synthetic construct
AKGKFHLDP

SEQ ID NO: 2024 - protein, 10 aa, synthetic construct
TTDYGAIMDV

SEQ ID NO: 2025 - protein, 12 aa, synthetic construct
ARDSRNYFGMGV

SEQ ID NO: 2026 - protein, 12 aa, synthetic construct
GRDGTRFGAFDI

SEQ ID NO: 2027 - protein, 9 aa, synthetic construct
ARGRSWYNH

SEQ ID NO: 2028 - protein, 13 aa, synthetic construct
ARFQPRPLRLFDY

SEQ ID NO: 2029 - protein, 14 aa, synthetic construct
ARASYGSGSYPLIH

SEQ ID NO: 2030 - protein, 11 aa, synthetic construct
AGHRSNIGWDV

SEQ ID NO: 2031 - protein, 17 aa, synthetic construct
ARDDRVRFSPVRRWFDP

SEQ ID NO: 2032 - protein, 11 aa, synthetic construct
ARSARGRWFDP

SEQ ID NO: 2033 - protein, 17 aa, synthetic construct
AKGQRAHQQLVRGAMDV

SEQ ID NO: 2034 - protein, 14 aa, synthetic construct
AHRRRSKFWSGFGV

SEQ ID NO: 2035 - protein, 12 aa, synthetic construct
ARKTGGHYPFDY

SEQ ID NO: 2036 - protein, 11 aa, synthetic construct
VKGAPAGYLDS

SEQ ID NO: 2037 - protein, 12 aa, synthetic construct
ARHNRERRAFDI

SEQ ID NO: 2038 - protein, 19 aa, synthetic construct
ARDSRVRGTHDYYYYGMDV

SEQ ID NO: 2039 - protein, 9 aa, synthetic construct
ARGSLRFTP

SEQ ID NO: 2040 - protein, 13 aa, synthetic construct
ARLSADRVFAFDI

SEQ ID NO: 2041 - protein, 11 aa, synthetic construct
AGHRSNIGWDV

SEQ ID NO: 2042 - protein, 15 aa, synthetic construct
ARVPLRGSGRLSFDY

SEQ ID NO: 2043 - protein, 16 aa, synthetic construct
AKSRRPRYSYGFAFES

SEQ ID NO: 2044 - protein, 11 aa, synthetic construct
ARDTSVGWFDP

SEQ ID NO: 2045 - protein, 12 aa, synthetic construct
VRDLTRRAAMDV

SEQ ID NO: 2046 - protein, 14 aa, synthetic construct
ARNGAGSHYYAMDV

SEQ ID NO: 2047 - protein, 12 aa, synthetic construct
ASSKVTRSALDY

SEQ ID NO: 2048 - protein, 10 aa, synthetic construct
GRESGRGSGT

SEQ ID NO: 2049 - protein, 15 aa, synthetic construct
ARERELYYFYYGMDV

SEQ ID NO: 2050 - protein, 12 aa, synthetic construct
ARHHNRRSSLDY

SEQ ID NO: 2051 - protein, 16 aa, synthetic construct
ARRGRRQLRYYYGMDV

SEQ ID NO: 2052 - protein, 10 aa, synthetic construct
ARARRRSFDW

SEQ ID NO: 2053 - protein, 11 aa, synthetic construct
ARSLRGNAFDI

SEQ ID NO: 2054 - protein, 9 aa, synthetic construct
AKDLQSRGY

SEQ ID NO: 2055 - protein, 11 aa, synthetic construct
ARHSRLAALLA

SEQ ID NO: 2056 - protein, 11 aa, synthetic construct
AVTGTTGWFDP

SEQ ID NO: 2057 - protein, 12 aa, synthetic construct
ARVGIAGRGMDV

SEQ ID NO: 2058 - protein, 13 aa, synthetic construct
ARVSRGYPRRSDS

SEQ ID NO: 2059 - protein, 10 aa, synthetic construct
VRSSNWKFDQ

SEQ ID NO: 2060 - protein, 12 aa, synthetic construct
ARDQARYYGMDV

SEQ ID NO: 2061 - protein, 8 aa, synthetic construct
ARGRRLDY

SEQ ID NO: 2062 - protein, 11 aa, synthetic construct
ARSGSFLSFDS

SEQ ID NO: 2063 - protein, 12 aa, synthetic construct
ARGGGASNWFDP

SEQ ID NO: 2064 - protein, 15 aa, synthetic construct
ARVPLRGSGRLSFDY

SEQ ID NO: 2065 - protein, 6 aa, synthetic construct
ARVPGN

SEQ ID NO: 2066 - protein, 15 aa, synthetic construct
GNGGRTYGHSRARYD

SEQ ID NO: 2067 - protein, 15 aa, synthetic construct
GNGGRKYGHHRARYD

SEQ ID NO: 2068 - protein, 15 aa, synthetic construct
GNGGRKYGHHRARYD

SEQ ID NO: 2069 - protein, 15 aa, synthetic construct
GNGGRTYGHSRARYE

SEQ ID NO: 2070 - protein, 15 aa, synthetic construct
GNGGRQYGHSRARYD

SEQ ID NO: 2071 - protein, 15 aa, synthetic construct
GNGGRNYGHSRARYD

SEQ ID NO: 2072 - protein, 19 aa, synthetic construct
APRPKRVSVQYFSTSSNYD

SEQ ID NO: 2073 - protein, 15 aa, synthetic construct
GNGGRHYGHSRARYD

SEQ ID NO: 2074 - protein, 15 aa, synthetic construct
GNGGRSYGHSRARYD

SEQ ID NO: 2075 - protein, 15 aa, synthetic construct
EGGYSGTYYYTGDFD

SEQ ID NO: 2076 - protein, 15 aa, synthetic construct
GNGGSKYGHSRARYD

SEQ ID NO: 2077 - protein, 15 aa, synthetic construct
GNGGRQYGHSRARYD

SEQ ID NO: 2078 - protein, 19 aa, synthetic construct
APRPKRVSVSYFSTASNYD

SEQ ID NO: 2079 - protein, 15 aa, synthetic construct
GNGGRTYGHSRARYD

SEQ ID NO: 2080 - protein, 15 aa, synthetic construct
GNGGRHYGHSRARYD

SEQ ID NO: 2081 - protein, 15 aa, synthetic construct
GNGGRAYGYSRARYE

SEQ ID NO: 2082 - protein, 15 aa, synthetic construct
GNGGRLYGHSRARYD

SEQ ID NO: 2083 - protein, 19 aa, synthetic construct
APRPKRASVQYFSTSSNYD

SEQ ID NO: 2084 - protein, 15 aa, synthetic construct
GNGGRSYGHSRARYD

SEQ ID NO: 2085 - protein, 15 aa, synthetic construct
GNGGRYYNHSRTRYE

SEQ ID NO: 2086 - protein, 15 aa, synthetic construct
GNGGRNYGHSRARYE

SEQ ID NO: 2087 - protein, 15 aa, synthetic construct
GNGGRYYGHSRARYD

SEQ ID NO: 2088 - protein, 15 aa, synthetic construct
GNGGRKYGHHRARYD

SEQ ID NO: 2089 - protein, 19 aa, synthetic construct
APRPKRVSVSYFSTASNYD

SEQ ID NO: 2090 - protein, 19 aa, synthetic construct
APRPKRVSVRYFSTSSNYD

SEQ ID NO: 2091 - protein, 15 aa, synthetic construct
GNGGRQYGHSRARYD

SEQ ID NO: 2092 - protein, 15 aa, synthetic construct
GNGGRTYGHSRARYE

SEQ ID NO: 2093 - protein, 19 aa, synthetic construct
APRPKRISVQYFTTSSNYD

SEQ ID NO: 2094 - protein, 15 aa, synthetic construct
GNGGRQYGHSRARYD

SEQ ID NO: 2095 - protein, 15 aa, synthetic construct
GNGGRYYGHSRARYD

SEQ ID NO: 2096 - protein, 15 aa, synthetic construct
GNGGRQYGHSRARYD

SEQ ID NO: 2097 - protein, 19 aa, synthetic construct
APRPKRVSVHYFSTSSNYD

SEQ ID NO: 2098 - protein, 19 aa, synthetic construct
APRPKRVSVSYFSTASNYD

SEQ ID NO: 2099 - protein, 19 aa, synthetic construct
APRPKYVSVRYFSTSSNYD

SEQ ID NO: 2100 - protein, 15 aa, synthetic construct
GNGGRKYGHHRARYD

SEQ ID NO: 2101 - protein, 15 aa, synthetic construct
GNGGRTYGHSRARYE

SEQ ID NO: 2102 - protein, 15 aa, synthetic construct
GNGGRKYGHHRARYD

SEQ ID NO: 2103 - protein, 15 aa, synthetic construct
GNGGRNYGHSRARYD

SEQ ID NO: 2104 - protein, 15 aa, synthetic construct
GNGGRYYNHSRTRYE

SEQ ID NO: 2105 - protein, 15 aa, synthetic construct
GNGGRNYGHSRARYD

SEQ ID NO: 2106 - protein, 15 aa, synthetic construct
GNGGRHYGHSRARYD

SEQ ID NO: 2107 - protein, 15 aa, synthetic construct
GNGGRAYGYSRARYE

SEQ ID NO: 2108 - protein, 19 aa, synthetic construct
APRPKRVSFSYFSTSSNYE

SEQ ID NO: 2109 - protein, 15 aa, synthetic construct
GNGGRSYGHSRARYD

SEQ ID NO: 2110 - protein, 15 aa, synthetic construct
GNGGRAYGYSRARYE

SEQ ID NO: 2111 - protein, 15 aa, synthetic construct
GNGGRSYGHSRARYD

SEQ ID NO: 2112 - protein, 15 aa, synthetic construct
GNGGRTYGHSRARYE

SEQ ID NO: 2113 - protein, 15 aa, synthetic construct
GNGGRHYGHSRARYD

SEQ ID NO: 2114 - protein, 15 aa, synthetic construct
GNGGRKYGHHRARYD

SEQ ID NO: 2115 - protein, 19 aa, synthetic construct
APRPKRASVQYFSTSSNYD

SEQ ID NO: 2116 - protein, 15 aa, synthetic construct
GNGGRHYGHSRARYD

SEQ ID NO: 2117 - protein, 15 aa, synthetic construct
GNGGRYYGHSRARYD

SEQ ID NO: 2118 - protein, 19 aa, synthetic construct
APRPKYVSVSYFSTSSNYD

SEQ ID NO: 2119 - protein, 19 aa, synthetic construct
APRPKRVSFSYFSTSSNYE

SEQ ID NO: 2120 - protein, 15 aa, synthetic construct
GNGGRYYNHSRTRYE

SEQ ID NO: 2121 - protein, 15 aa, synthetic construct
EGGYSGTYYYTGDFD

SEQ ID NO: 2122 - protein, 19 aa, synthetic construct
APRPKSISVRYFSTSSNYE

SEQ ID NO: 2123 - protein, 8 aa, synthetic construct
GKRYGYYD

SEQ ID NO: 2124 - protein, 19 aa, synthetic construct
APRPTRVSVRYFSTRSNYN

SEQ ID NO: 2125 - protein, 12 aa, synthetic construct
YLSFYSDYEVYD

SEQ ID NO: 2126 - protein, 15 aa, synthetic construct
GNGGRQYGHSRARYD

SEQ ID NO: 2127 - protein, 15 aa, synthetic construct
GNGGRKYGHHRARYD

SEQ ID NO: 2128 - protein, 15 aa, synthetic construct
GNGGRAYGYSRARYE

SEQ ID NO: 2129 - protein, 15 aa, synthetic construct
GNGGRKYGHHRARYD

SEQ ID NO: 2130 - protein, 15 aa, synthetic construct
GNGGRTYGHSRARYE

SEQ ID NO: 2131 - protein, 15 aa, synthetic construct
GNGGRAYGYSRARYE

SEQ ID NO: 2132 - protein, 15 aa, synthetic construct
GNGGRAYGYSRARYE

SEQ ID NO: 2133 - protein, 15 aa, synthetic construct
GNGGRQYGHSRARYD

SEQ ID NO: 2134 - protein, 19 aa, synthetic construct
APRPKRVSFSYFSTSSNYE

SEQ ID NO: 2135 - protein, 15 aa, synthetic construct
GNGGRAYGYSRARYE

SEQ ID NO: 2136 - protein, 15 aa, synthetic construct
GNGGRSYGHSRARYD

SEQ ID NO: 2137 - protein, 15 aa, synthetic construct
GNGGRAYGYSRARYE

SEQ ID NO: 2138 - protein, 15 aa, synthetic construct
GNGGRQYGHSRARYD

SEQ ID NO: 2139 - protein, 15 aa, synthetic construct
GNGGRSYGHSRARYD

SEQ ID NO: 2140 - protein, 19 aa, synthetic construct
APRPKRVSVSYFSTASNYD

SEQ ID NO: 2141 - protein, 19 aa, synthetic construct
APRPKRVSVQYFVTSSNYD

SEQ ID NO: 2142 - protein, 15 aa, synthetic construct
GNGGRQYGHSRARYD

SEQ ID NO: 2143 - protein, 19 aa, synthetic construct
APRPKRVSVQYFSTSSNYD

SEQ ID NO: 2144 - protein, 15 aa, synthetic construct
GNGGRTYGHSRARYD

SEQ ID NO: 2145 - protein, 19 aa, synthetic construct
APRPKRASVQYFSTSSNYD

SEQ ID NO: 2146 - protein, 15 aa, synthetic construct
GNGGRAYGYSRARYE

SEQ ID NO: 2147 - protein, 15 aa, synthetic construct
GNGGRQYGHSRARYD

SEQ ID NO: 2148 - protein, 15 aa, synthetic construct
GNGGRTYGHSRARYE

SEQ ID NO: 2149 - protein, 15 aa, synthetic construct
GNGGSRYGHSRARYD

SEQ ID NO: 2150 - protein, 15 aa, synthetic construct
GNGGRNYGHSRARYD

SEQ ID NO: 2151 - protein, 15 aa, synthetic construct
GNGGRTYGHSRARYE

SEQ ID NO: 2152 - protein, 15 aa, synthetic construct
GNGGRQYGHSRARYD

SEQ ID NO: 2153 - protein, 15 aa, synthetic construct
GNGGRQYGHSRARYD

SEQ ID NO: 2154 - protein, 15 aa, synthetic construct
GNGGRAYGYSRARYE

SEQ ID NO: 2155 - protein, 15 aa, synthetic construct
GNGGRHYGHSRARYD

SEQ ID NO: 2156 - protein, 15 aa, synthetic construct
GNGGRSYGHSRARYD

SEQ ID NO: 2157 - protein, 19 aa, synthetic construct
APRPKRISVSYFSTTSNYD

SEQ ID NO: 2158 - protein, 15 aa, synthetic construct
GNGGRQYGHSRARYD

SEQ ID NO: 2159 - protein, 19 aa, synthetic construct
APRPKRVSVSYFSTASNYD

SEQ ID NO: 2160 - protein, 19 aa, synthetic construct
APRPKRVSVRYFSTSSNYD

SEQ ID NO: 2161 - DNA, 112 bp, synthetic construct
  source 1..112: mol_type = other DNA
  modified_base 101: mod_base = OTHER; note = Thymidine-succinyl hexamide cyanoethyl diisopropyl phosphoramidite
  modified_base 102: mod_base = OTHER; note = Thymidine-succinyl hexamide cyanoethyl diisopropyl phosphoramidite
cgggatccttatcgtcatcgtcgtacagatcccgacccatttgctgtccaccagtcatgctagccataccatgatgatgatgatgatgagaaccccgcattttttttttttt

SEQ ID NO: 2162 - DNA, 19 bp, synthetic construct
  source 1..19: mol_type = other DNA
atgcggggttctcatcatc

SEQ ID NO: 2163 - DNA, 20 bp, synthetic construct
  source 1..20: mol_type = other DNA
cgggatccttatcgtcatcg

SEQ ID NO: 2164 - protein, 124 aa, synthetic construct; identical to SEQ ID NO: 368

SEQ ID NO: 2165 - protein, 124 aa, synthetic construct; identical to SEQ ID NO: 366

SEQ ID NO: 2166 - protein, 124 aa, synthetic construct; identical to SEQ ID NO: 307

SEQ ID NO: 2167 - protein, 123 aa, synthetic construct; identical to SEQ ID NO: 359

SEQ ID NO: 2168 - protein, 124 aa, synthetic construct
EVQLVESGGGLVQPGGSLRLSCAASGTTFRINVMGWFRQAPGKEREFVAVVNWNGGSTIYADSVKGRFTISADNSKNTAYLQMNSLKPEDTAVYYCAAGNGGRQYGHSRARYDWGQGTLVTVSS

SEQ ID NO: 2169 - protein, 123 aa, synthetic construct
EVQLVESGGGLVQPGGSLRLSCAASGRTFSNNVMGWFRQAPGKEREMVAAMLSGGSTNYADSVKGRFTISADNSKNTAYLQMNSLKPEDTAVYYCAAGNGGRNYGHSRARYDWGQGTLVTVSS

SEQ ID NO: 2170 - protein, 128 aa, synthetic construct; identical to SEQ ID NO: 481

SEQ ID NO: 2171 - protein, 123 aa, synthetic construct
EVQLVESGGGLVQPGGSLRLSCAASGHTYNTYPMGWFRQAPGKERELVAVILRGGSTVYADSVKGRFTISADNSKNTAYLQMNSLKPEDTAVYYCAAGNGGRHYGHSRARYDWGQGTLVTVSS

SEQ ID NO: 2172 - protein, 124 aa, synthetic construct
EVQLVESGGGLVQPGGSLRLSCAASGRSLYDRAMGWFRQAPGKEREIVAAISRTGSSIYYADSVKGRFTISADNSKNTAYLQMNSLKPEDTAVYYCAAGNGGRSYGHSRARYDWGQGTLVTVSS

SEQ ID NO: 2173 - protein, 124 aa, synthetic construct
EVQLVESGGGLVQPGGSLRLSCAASGRTFNNYAMGWFRQAPGKERELVAAISWSTGSTYYADSVKGRFTISADNSKNTAYLQMNSLKPEDTAVYYCAAEGGYSGTYYYTGDFDWGQGTLVTVSS

SEQ ID NO: 2174 - protein, 124 aa, synthetic construct
EVQLVESGGGLVQPGGSLRLSCAASGRTLYSYPMGWFRQAPGKEREFVAAISWSAGSTYYADSVKGRFTISADNSKNTAYLQMNSLKPEDTAVYYCAAGNGGSKYGHSRARYDWGQGTLVTVSS

SEQ ID NO: 2175 - protein, 124 aa, synthetic construct
EVQLVESGGGLVQPGGSLRLSCAASGTFRDYAMGWFRQAPGKERELVAAIYGTGGELVYYADSVKGRFTISADNSKNTAYLQMNSLKPEDTAVYYCAAGNGGRQYGHSRARYDWGQGTLVTVSS

SEQ ID NO: 2176 - protein, 129 aa, synthetic construct
EVQLVESGGGLVQPGGSLRLSCAASGGGTFGSYAMGWFRQAPGKEREFVSAITWNGTRTYYADSVKGRFTISADNSKNTAYLQMNSLKPEDTAVYYCAAAPRPKRVSVSYFSTASNYDWGQGTLVTVSS

SEQ ID NO: 2177 - protein, 124 aa, synthetic construct
EVQLVESGGGLVQPGGSLRLSCAASGRTFSNYPMGWFRQAPGKEREFVAATSWSGGSKYYADSVKGRFTISADNSKNTAYLQMNSLKPEDTAVYYCAAGNGGRTYGHSRARYDWGQGTLVTVSS

SEQ ID NO: 2178 - protein, 124 aa, synthetic construct
EVQLVESGGGLVQPGGSLRLSCAASGRTFTNYAMGWFRQAPGKEREFVATISRGGSATYYADSVKGRFTISADNSKNTAYLQMNSLKPEDTAVYYCAAGNGGRHYGHSRARYDWGQGTLVTVSS

SEQ ID NO: 2179 - protein, 123 aa, synthetic construct; identical to SEQ ID NO: 478

SEQ ID NO: 2180 - protein, 124 aa, synthetic construct
EVQLVESGGGLVQPGGSLRLSCAASGRSFSMYAMGWFRQAPGKEREFVAAISRDGAATYYADSVKGRFTISADNSKNTAYLQMNSLKPEDTAVYYCAAGNGGRLYGHSRARYDWGQGTLVTVSS

SEQ ID NO: 2181 - protein, 128 aa, synthetic construct
EVQLVESGGGLVQPGGSLRLSCAASGLTFRNYAMGWFRQAPGKEREFVAAVSWSLSRTHYADSVKGRFTISADNSKNTAYLQMNSLKPEDTAVYYCAAAPRPKRASVQYFSTSSNYDWGQGTLVTVSS

SEQ ID NO: 2182 - protein, 124 aa, synthetic construct
EVQLVESGGGLVQPGGSLRLSCAASGFTFDDRAMGWFRQAPGKERELVAAIRWSGGITWYADSVKGRFTISADNSKNTAYLQMNSLKPEDTAVYYCAAGNGGRSYGHSRARYDWGQGTLVTVSS

SEQ ID NO: 2183 - protein, 123 aa, synthetic construct
EVQLVESGGGLVQPGGSLRLSCAASGRTFSSVMGWFRQAPGKEREFVAAINWSGASTVYADSVKGRFTISADNSKNTAYLQMNSLKPEDTAVYYCAAGNGGRYYNHSRTRYEWGQGTLVTVSS

SEQ ID NO: 2184 - protein, 124 aa, synthetic construct
EVQLVESGGGLVQPGGSLRLSCAASGHTFNTYPMGWFRQAPGKEREFVAAINSGGSYTYYADSVKGRFTISADNSKNTAYLQMNSLKPEDTAVYYCAAGNGGRNYGHSRARYEWGQGTLVTVSS

SEQ ID NO: 2185 - protein, 121 aa, synthetic construct
EVQLVESGGGLVQPGGSLRLSCAASGRIFTMGWFRQAPGKEREFVAAISGSGVYTYYADSVKGRFTISADNSKNTAYLQMNSLKPEDTAVYYCAAGNGGRYYGHSRARYDWGQGTLVTVSS

SEQ ID NO: 2186 - protein, 124 aa, synthetic construct; identical to SEQ ID NO: 502

SEQ ID NO: 2187 - protein, 128 aa, synthetic construct
EVQLVESGGGLVQPGGSLRLSCAASGFNSGSYTMGWFRQAPGKEREFVAAISWSLSRTFYADSVKGRFTISADNSKNTAYLQMNSLKPEDTAVYYCAAAPRPKRVSVSYFSTASNYDWGQGTLVTVSS

SEQ ID NO: 2188 - protein, 126 aa, synthetic construct
EVQLVESGGGLVQPGGSLRLSCAASGGTAYAMGWFRQAPGKEREFVAAISWSLTRTHYADSVKGRFTISADNSKNTAYLQMNSLKPEDTAVYYCAAAPRPKRVSVRYFSTSSNYDWGQGTLVTVSS

SEQ ID NO: 2189 - protein, 124 aa, synthetic construct
EVQLVESGGGLVQPGGSLRLSCAASGRTFTSYPMGWFRQAPGKEREFVAAISGSGDDTYYADSVKGRFTISADNSKNTAYLQMNSLKPEDTAVYYCAAGNGGRQYGHSRARYDWGQGTLVTVSS

SEQ ID NO: 2190 - protein, 123 aa, synthetic construct; identical to SEQ ID NO: 493

SEQ ID NO: 2191 - protein, 130 aa, synthetic construct
EVQLVESGGGLVQPGGSLRLSCAASGGTLNNNPMAMGWFRQAPGKEREFVASINWSGARAYYADSVKGRFTISADNSKNTAYLQMNSLKPEDTAVYYCAAAPRPKRISVQYFTTSSNYDWGQGTLVTVSS

SEQ ID NO: 2192 - protein, 123 aa, synthetic construct
EVQLVESGGGLVQPGGSLRLSCAASGRTFSTYPMGWFRQAPGKEREFVAGIGTRGAPVYADSVKGRFTISADNSKNTAYLQMNSLKPEDTAVYYCAAGNGGRQYGHSRARYDWGQGTLVTVSS

SEQ ID NO: 2193 - protein, 123 aa, synthetic construct
EVQLVESGGGLVQPGGSLRLSCAASGRTFNSYPMGWFRQAPGKEREFVAHITRLGVTYYADSVKGRFTISADNSKNTAYLQMNSLKPEDTAVYYCAAGNGGRYYGHSRARYDWGQGTLVTVSS

SEQ ID NO: 2194 - protein, 123 aa, synthetic construct
EVQLVESGGGLVQPGGSLRLSCAASGIPFSSRTMGWFRQAPGKEREFVAAVGWYGSTYYADSVKGRFTISADNSKNTAYLQMNSLKPEDTAVYYCAAGNGGRQYGHSRARYDWGQGTLVTVSS

SEQ ID NO: 2195 - protein, 128 aa, synthetic construct
EVQLVESGGGLVQPGGSLRLSCAASGIDVNRNAMGWFRQAPGKERELVAAISWSGGRTYYADSVKGRFTISADNSKNTAYLQMNSLKPEDTAVYYCAAAPRPKRVSVHYFSTSSNYDWGQGTLVTVSS

SEQ ID NO: 2196 - protein, 128 aa, synthetic construct
EVQLVESGGGLVQPGGSLRLSCAASGINFSRYGMGWFRQAPGKEREFVAAIDWSGSRSYYADSVKGRFTISADNSKNTAYLQMNSLKPEDTAVYYCAAAPRPKRVSVSYFSTASNYDWGQGTLVTVSS

SEQ ID NO: 2197 - protein, 128 aa, synthetic construct
EVQLVESGGGLVQPGGSLRLSCAASGGTLRGYGMGWFRQAPGKEREFVAAIDWSGSRSYYADSVKGRFTISADNSKNTAYLQMNSLKPEDTAVYYCAAAPRPKYVSVRYFSTSSNYDWGQGTLVTVSS

SEQ ID NO: 2198 - protein, 121 aa, synthetic construct
EVQLVESGGGLVQPGGSLRLSCAASGQTFNMGWFRQAPGKEREFVAAVNWNGDSTYYADSVKGRFTISADNSKNTAYLQMNSLKPEDTAVYYCAAGNGGRKYGHHRARYDWGQGTLVTVSS

SEQ ID NO: 2199 - protein, 123 aa, synthetic construct
EVQLVESGGGLVQPGGSLRLSCAASGYTFRAYVMGWFRQAPGKEREWVARITSGGSTIYADSVKGRFTISADNSKNTAYLQMNSLKPEDTAVYYCAAGNGGRTYGHSRARYEWGQGTLVTVSS

SEQ ID NO: 2200 - protein, 124 aa, synthetic construct
EVQLVESGGGLVQPGGSLRLSCAASGNIFTLNVMGWFRQAPGKEREFVAAINSGGSYTYYADSVKGRFTISADNSKNTAYLQMNSLKPEDTAVYYCAAGNGGRKYGHHRARYDWGQGTLVTVSS

SEQ ID NO: 2201 - protein, 124 aa, synthetic construct
EVQLVESGGGLVQPGGSLRLSCAASGFRMYDRAMGWFRQAPGKEREFVAAISGRSGNTYYADSVKGRFTISADNSKNTAYLQMNSLKPEDTAVYYCAAGNGGRNYGHSRARYDWGQGTLVTVSS

SEQ ID NO: 2202 - protein, 124 aa, synthetic construct
EVQLVESGGGLVQPGGSLRLSCAASGFTFSMWPMGWFRQAPGKEREFVAAISRSGGSTIYADSVKGRFTISADNSKNTAYLQMNSLKPEDTAVYYCAAGNGGRYYNHSRTRYEWGQGTLVTVSS

SEQ ID NO: 2203 - protein, 123 aa, synthetic construct
EVQLVESGGGLVQPGGSLRLSCAASGFTFRSYPMGWFRQAPGKEREFVALIHTGGGTYYADSVKGRFTISADNSKNTAYLQMNSLKPEDTAVYYCAAGNGGRNYGHSRARYDWGQGTLVTVSS

SEQ ID NO: 2204 - protein, 123 aa, synthetic construct
EVQLVESGGGLVQPGGSLRLSCAASGLPFSTKSMGWFRQAPGKERELVAFSSSGGRTIYADSVKGRFTISADNSKNTAYLQMNSLKPEDTAVYYCAAGNGGRHYGHSRARYDWGQGTLVTVSS

SEQ ID NO: 2205 - protein, 124 aa, synthetic construct
EVQLVESGGGLVQPGGSLRLSCAASGNIFRINAMGWFRQAPGKEREWVARINSGGSSTYYADSVKGRFTISADNSKNTAYLQMNSLKPEDTAVYYCAAGNGGRAYGYSRARYEWGQGTLVTVSS

SEQ ID NO: 2206 - protein, 128 aa, synthetic construct
EVQLVESGGGLVQPGGSLRLSCAASGGTFGHYAMGWFRQAPGKEREFVAVISWSLTRTHYADSVKGRFTISADNSKNTAYLQMNSLKPEDTAVYYCAAAPRPKRVSFSYFSTSSNYEWGQGTLVTVSS

SEQ ID NO: 2207 - protein, 124 aa, synthetic construct
EVQLVESGGGLVQPGGSLRLSCAASGRTFNSYPMGWFRQAPGKEREFVAAITWGGSTTLYADSVKGRFTISADNSKNTAYLQMNSLKPEDTAVYYCAAGNGGRSYGHSRARYDWGQGNLVTVSS

SEQ ID NO: 2208 - protein, 124 aa, synthetic construct
EVQLVESGGGLVQPGGSLRLSCAASGITFRRYPMGWFRQAPGKEREFVAGVNWGGGSTKYADSVKGRFTISADNSKNTAYLQMNSLKPEDTAVYYCAAGNGGRAYGYSRARYEWGQGTLVTVSS

SEQ ID NO: 2209 - protein, 123 aa, synthetic construct
EVQLVESGGGLVQPGGSLRLSCAASGRTFSYNPMGWFRQAPGKEREMVATISIGGRTSYADSVKGRFTISADNSKNTAYLQMNSLKPEDTAVYYCAAGNGGRSYGHSRARYDWGQGTLVTVSS

SEQ ID NO: 2210 - protein, 123 aa, synthetic construct
EVQLVESGGGLVQPGGSLRLSCAASGRTFSSLPMGWFRQAPGKEREFVAAIRSSGGLFYADSVKGRFTISADNSKNTAYLQMNSLKPEDTAVYYCAAGNGGRTYGHSRARYEWGQGTLVTVSS

SEQ ID NO: 2211 - protein, 127 aa, synthetic construct
EVQLVESGGGLVQPGGSLRLSCAASGPTFSTNTMGWFRQAPGKEREFVAAIYSGVRSGVSAIYADSVKGRFTISADNSKNTAYLQMNSLKPEDTAVYYCAAGNGGRHYGHSRARYDWGQGTLVTVSS

SEQ ID NO: 2212 - protein, 125 aa, synthetic construct
EVQLVESGGGLVQPGGSLRLSCAASGRTFSNYPMGWFRQAPGKEREFVAAIYGTGGELVYYADSVKGRFTISADNSKNTAYLQMNSLKPEDTAVYYCAAGNGGRKYGHHRARYDWGQGTLVTVSS

SEQ ID NO: 2213 - protein, 128 aa, synthetic construct
EVQLVESGGGLVQPGGSLRLSCAASGRAIGSYAMGWFRQAPGKEREFVATITFSGARTHYADSVKGRFTISADNSKNTAYLQMNSLKPEDTAVYYCAAAPRPKRASVQYFSTSSNYDWGQGTLVTVSS

SEQ ID NO: 2214 - protein, 122 aa, synthetic construct
EVQLVESGGGLVQPGGSLRLSCAASGRTLSRNTMGWFRQAPGKEREFVATIRSGAPVYADSVKGRFTISADNSKNTAYLQMNSLKPEDTAVYYCAAGNGGRHYGHSRARYDWGQGTLVTVSS

SEQ ID NO: 2215 - protein, 123 aa, synthetic construct
EVQLVESGGGLVQPGGSLRLSCAASGRTFIGYHMGWFRQAPGKERELVAIKFSGGTTNYADSVKGRFTISADNSKNTAYLQMNSLKPEDTAVYYCAAGNGGRYYGHSRARYDWGQGTLVTVSS

SEQ ID NO: 2216 - protein, 128 aa, synthetic construct; identical to SEQ ID NO: 304

SEQ ID NO: 2217 - protein, 128 aa, synthetic construct
EVQLVESGGGLVQPGGSLRLSCAASGRTISNYAMGWFRQAPGKEREFVAAISWALSRTHYADSVKGRFTISADNSKNTAYLQMNSLKPEDTAVYYCAAAPRPKRVSFSYFSTSSNYEWGQGTLVTVSS

SEQ ID NO: 2218 - protein, 123 aa, synthetic construct
EVQLVESGGGLVQPGGSLRLSCAASGTFTSYPMGWFRQAPGKEREFVAAISWTGGSTVYADSVKGRFTISADNSKNTAYLQMNSLKPEDTAVYYCAAGNGGRYYNHSRTRYEWGQGTLVTVSS

SEQ ID NO: 2219 - protein, 124 aa, synthetic construct; identical to SEQ ID NO: 303

SEQ ID NO: 2220 - protein, 128 aa, synthetic construct
EVQLVESGGGLVQPGGSLRLSCAASGLTFRNYAMGWFRQAPGKEREFVAAINWSGARTYYADSVKGRFTISADNSKNTAYLQMNSLKPEDTAVYYCAAAPRPKSISVRYFSTSSNYEWGQGTLVTVSS

SEQ ID NO: 2221 - protein, 117 aa, synthetic construct
EVQLVESGGGLVQPGGSLRLSCAASGFTFSSYAMGWFRQAPGKEREWVSAISADGSDKRYADSVKGRFTISADNSKNTAYLQMNSLKPEDTAVYYCAAGKRYGYYDWGQGTLVTVSS

SEQ ID NO: 2222 - protein, 128 aa, synthetic construct
EVQLVESGGGLVQPGGSLRLSCAASGRTHSIYPMGWFRQAPGKEREFVATIRWGTTDTYYADSVKGRFTISADNSKNTAYLQMNSLKPEDTAVYYCAAAPRPTRVSVRYFSTRSNYNWGQGTLVTVSS

SEQ ID NO: 2223 - protein, 121 aa, synthetic construct
EVQLVESGGGLVQPGGSLRLSCAASGFSLDYVGMGWFRQAPGKEREGVSTIKPSGDTTNYADSVKGRFTISADNSKNTAYLQMNSLKPEDTAVYYCAKYLSFYSDYEVYDWGQGTLVTVSS

SEQ ID NO: 2224 - protein, 124 aa, synthetic construct
EVQLVESGGGLVQPGGSLRLSCAASGSIFRVNVMGWFRQAPGKEREFVGAISMSGANTYYADSVKGRFTISADNSKNTAYLQMNSLKPEDTAVYYCAAGNGGRQYGHSRARYDWGQGTLVTVSS

SEQ ID NO: 2225 - protein, 124 aa, synthetic construct
EVQLVESGGGLVQPGGSLRLSCAASGRTFSSLPMGWFRQAPGKERELVAALNWSGGNTYYADSVKGRFTISADNSKNTAYLQMNSLKPEDTAVYYCAAGNGGRKYGHHRARYDWGQGTLVTVSS

SEQ ID NO: 2226 - protein, 124 aa, synthetic construct
EVQLVESGGGLVQPGGSLRLSCAASGFLMYDRAMGWFRQAPGKEREIVAAISRTGSSIYYADSVKGRFTISADNSKNTAYLQMNSLKPEDTAVYYCAAGNGGRAYGYSRARYEWGQGTLVTVSS

SEQ ID NO: 2227 - protein, 124 aa, synthetic construct
EVQLVESGGGLVQPGGSLRLSCAASGDISSYVMGWFRQAPGKEREFVARITWNGGTHTYYADSVKGRFTISADNSKNTAYLQMNSLKPEDTAVYYCAAGNGGRKYGHHRARYDWGQSTLVTVSS

SEQ ID NO: 2228 - protein, 124 aa, synthetic construct
EVQLVESGGGLVQPGGSLRLSCAASGRTHSIYPMGWFRQAPGKERELVAAVNWNGDSTYYADSVKGRFTISADNSKNTAYLQMNSLKPEDTAVYYCAAGNGGRTYGHSRARYEWGQGTLVTVSS

SEQ ID NO: 2229 - protein, 124 aa, synthetic construct
EVQLVESGGGLVQPGGSLRLSCAASGIPFSSRTMGWFRQAPGKEREFVAAISRSGTGTYYADSVKGRFTISADNSKNTAYLQMNSLKPEDTAVYYCAAGNGGRAYGYSRARYEWGQGTLVTVSS

SEQ ID NO: 2230 - protein, 122 aa, synthetic construct
EVQLVESGGGLVQPGGSLRLSCAASGRTFSNYPMGWFRQAPGKERELVAIIVNGGSTYADSVKGRFTISADNSKNTAYLQMNSLKPEDTAVYYCAAGNGGRAYGYSRARYEWGQGTLVTVSS

SEQ ID NO: 2231 - protein, 123 aa, synthetic construct
EVQLVESGGGLVQPGGSLRLSCAASGMTTIGPMGWFRQAPGKEREFVAAISWDGGNTYYADSVKGRFTISADNSKNTAYLQMNSLKPEDTAVYYCAAGNGGRQYGHSRARYDWGQGTLVTVSS

SEQ ID NO: 2232 - protein, 128 aa, synthetic construct
EVQLVESGGGLVQPGGSLRLSCAASGRASGDYAMGWFRQAPGKEREFVAAISWRGGNTYYADSVKGRFTISADNSKNTAYLQMNSLKPEDTAVYYCAAAPRPKRVSFSYFSTSSNYEWGQGTLVTVSS

SEQ ID NO: 2233 - protein, 123 aa, synthetic construct
EVQLVESGGGLVQPGGSLRLSCAASGRTFSSYPMGWFRQAPGKEREWVAHLLSGGSTVYADSVKGRFTISADNSKNTAYLQMNSLKPEDTAVYYCAAGNGGRAYGYSRARYEWGQGTLVTVSS

SEQ ID NO: 2234 - protein, 124 aa, synthetic construct
EVQLVESGGGLVQPGGSLRLSCAASGRTFSEVVMGWFRQAPGKERELVAVAHWSGGSTFYADSVKGRFTISADNSKNTAYLQMNSLKPEDTAVYYCAAGNGGRSYGHSRARYDWGQGTLVTVSS

SEQ ID NO: 2235 - protein, 123 aa, synthetic construct
EVQLVESGGGLVQPGGSLRLSCAASGSTFSINRMGWFRQAPGKEREFVARITPRGLTEYADSVKGRFTISADNSKNTTYLQMNSLKPEDTAVYYCAAGNGGRAYGYSRARYEWGQGTLVTVSS

SEQ ID NO: 2236 - protein, 121 aa, synthetic construct
EVQLVESGGGLVQPGGSLRLSCAASGRTFSFGWFRQAPGKEREFVAAVIWRGGSTYYADSVKGRFTISADNSKNTAYLQMNSLKPEDTAVYYCAAGNGGRQYGHSRARYDWGQGTLVTVSS

SEQ ID NO: 2237 - protein, 124 aa, synthetic construct
EVQLVESGGGLVQPGGSLRLSCAASGGTFSSYPMGWFRQAPGKEREFVAAISWSGSATFYADSVKGRFTISADNSKNTAYLQMNSLKPEDTAVYYCAAGNGGRSYGHSRARYDWGQGTLVTVSS

SEQ ID NO: 2238 - protein, 126 aa, synthetic construct
EVQLVESGGGLVQPGGSLRLSCAASGRTFSNFAMGWFRQAPGKEREFVAVILRGGSTYADSVKGRFTISADNSKNTAYLQMNSLKPEDTAVYYCAAAPRPKRVSVSYFSTASNYDWGQGTLVTVSS

SEQ ID NO: 2239 - protein, 128 aa, synthetic construct
EVQLVESGGGLVQPGGSLRLSCAASGGTFSRYAMGWFRQAPGKEREFVAAISWSLTRTHYADSVKGRFTISADNSKNTAYLQMNSLKPEDTAVYYCAAAPRPKRVSVQYFVTSSNYDWGQGTLVTVSS

SEQ ID NO: 2240 - protein, 124 aa, synthetic construct
EVQLVESGGGLVQPGGSLRLSCAASGRTLSRSNMGWFRQAPGKEREHVALIRIKDGSIYYADSVKGRFTISADNSKNTAYLQMNSLKPEDTAVYYCAAGNGGRQYGHSRARYDWGQGTLVTVSS

SEQ ID NO: 2241 - protein, 128 aa, synthetic construct
EVQLVESGGGLVQPGGSLRLSCAASGRTFSSGTMGWFRQAPGKERELVAAISRSGTLKAYADSVKGRFTISADNSKNTAYLQMNSLKPEDTAVYYCAAAPRPKRVSVQYFSTSSNYDWGQGTLVTVSS

SEQ ID NO: 2242 - protein, 123 aa, synthetic construct
EVQLVESGGGLVQPGGSLRLSCAASGRTFNSYPMGWFRQAPGKEREFVAAINVGGGTYYADSVKGRFTISADNSKNTAYLQMNSLKPEDTAVYYCAAGNGGRTYGHSRARYDWGQGTLVTVSS

SEQ ID NO: 2243 - protein, 129 aa, synthetic construct
EVQLVESGGGLVQPGGSLRLSCAASGYTLKNYYAMGWFRRAPGKEREFVAAISRSGGTTFYADSVKGRFTISADNSKNTAYLQMNSLKPEDTAVYYCAAAPRPKRASVQYFSTSSNYDWGQGTLVTVSS

SEQ ID NO: 2244 - protein, 122 aa, synthetic construct
EVQLVESGGGLVQPGGSLRLSCAASGHTFNTYPMGWFRQAPGKEREFVAAVSYSGSYYADSVKGRFTISADNSKNTAYLQMNSLKPEDTAVYYCAAGNGGRAYGYSRARYEWGQGTLVTVSS

SEQ ID NO: 2245 - protein, 124 aa, synthetic construct
EVQLVESGGGLVQPGGSLRLSCAASGFTFDDRAMGWFRQAPGKEREFVASISTSGTRTLYADSVKGRFTISADNSKNTAYLQMNSLKPEDTAVYYCAAGNGGRQYGHSRARYDWGQGTLVTVSS

SEQ ID NO: 2246 - protein, 123 aa, synthetic construct
EVQLVESGGGLVQPGGSLRLSCAASGRTLSSYAMGWFRQAPGKEREWVATIGTSGPPRYADSVKGRFTISADNSKNTAYLQMNSLKPEDTAVYYCAAGNGGRTYGHSRARYEWGQGTLVTVSS

SEQ ID NO: 2247 - protein, 124 aa, synthetic construct
EVQLVESGGGLVQPGGSLRLSCAASGRIFTNTAMGWFRQAPGKEREFVAAISWGGGLTVYADSVKGRFTISADNSKNTAYLQMNSLKPEDTAVYYCAAGNGGSRYGHSRARYDWGQGTLVTVSS

SEQ ID NO: 2248 - protein, 121 aa, synthetic construct
EVQLVESGGGLVQPGGSLRLSCAASGRIFTMGWFRQAPGKEREFVAAISWTAGTTYYADSVKGRFTISADNSKNTAYLQMNSLKPEDTAVYYCAAGNGGRNYGHSRARYDWGQGTLVTVSS

SEQ ID NO: 2249 - protein, 124 aa, synthetic construct
EVQLVESGGGLVQPGGSLRLSCAASGNIFTRHIMGWFRQAPGKEREWVARINTGGGSTFYADSVKGRFTISADNSKNTAYLQMNSLKPEDTAVYYCAAGNGGRTYGHSRARYEWGQGTLVTVSS

SEQ ID NO: 2250 - protein, 124 aa, synthetic construct
EVQLVESGGGLVQPGGSLRLSCAASGRTFSNYPMGWFRQAPGKEREFVAAISWSSGNAYYADSVKGRFTISADNSKNTAYLQMNSLKPEDTAVYYCAVGNGGRQYGHSRARYDWGQGTLVTVSS

SEQ ID NO: 2251 - protein, 123 aa, synthetic construct
EVQLVESGGGLVQPGGSLRLSCAASGRTFTSYPMGWFRQAPGKEREWVATIGTHGTPLYADSVKGRFTISADNSKNTAYLQMNSLKPEDTAVYYCAAGNGGRQYGHSRARYDWGQGTLVTVSS

SEQ ID NO: 2252 - protein, 118 aa, synthetic construct
EVQLVESGGGLVQPGGSLRLSCAASGQTFNGWFRQAPGKEREFVATISRSGVLYADSVKGRFTISADNSKNTAYLQMNSLKPEDTAVYYCAAGNGGRAYGYSRARYEWGQGTLVTVSS

SEQ ID NO: 2253 - protein, 124 aa, synthetic construct
EVQLVESGGGLVQPGGSLRLSCAASGRSFSEYPMGWFRQAPGKEREFVAAITWSGDMSVYADSVKGRFTISADNSKNTAYLQMNSLKPEDTAVYYCAAGNGGRHYGHSRARYDWGQGTLVTVSS

SEQ ID NO: 2254 - protein, 123 aa, synthetic construct
EVQLVESGGGLVQPGGSLRLSCAASGRSFSSYPMGWFRQAPGKEREFVATINTAGWTTYADSVKGRFTISADNSKNTAYLQMNSLKPEDTAVYYCAAGNGGRSYGHSRARYDWGQGTLVTVSS

SEQ ID NO: 2255 - protein, 128 aa, synthetic construct
EVQLVESGGGLVQPGGSLRLSCAASGLTFRNYAMGWFRQAPGKEREFVAAISWSGGKLYYADSVKGRFTISADNSKNTAYLQMNSLKPEDTAVYYCAAAPRPKRISVSYFSTTSNYDWGQGTLVTVSS

SEQ ID NO: 2256 - protein, 122 aa, synthetic construct
EVQLVESGGGLVQPGGSLRLSCAASGSTFSSYPMGWFRQAPGKERELVALIHTGGTYYADSVKGRFTISADNSKNTAYLQMNSLKPEDTAVYYCAAGNGGRQYGHSRARYDWGQGTLVTVSS

SEQ ID NO: 2257 - protein, 128 aa, synthetic construct
EVQLVESGGGLVQPGGSLRLSCAASGIDVNRNAMGWFRQAPGKEREFVGAVSWSGGTTVYADSVKGRFTISADNSKNTAYLQMNSLKPEDTAVYYCAAAPRPKRVSVSYFSTASNYDWGQGTLVTVSS

SEQ ID NO: 2258 - protein, 128 aa, synthetic construct
EVQLVESGGGLVQPGGSLRLSCAASGGTFNVYAMGWFRQAPGKEREFVAAINRSGKSTYYADSVKGRFTISADNSKNTAYLQMNSLKPEDTAVYYCAAAPRPKRVSVRYFSTSSNYDWGQGTLVTVSS

SEQ ID NO: 2259 - protein, 6 aa, synthetic construct
KLRNKY

SEQ ID NO: 2260 - protein, 6 aa, synthetic construct
QPIGPD

SEQ ID NO: 2261 - protein, 6 aa, synthetic construct
QSISSY

SEQ ID NO: 2262 - protein, 6 aa, synthetic construct
QDISNY

SEQ ID NO: 2263 - protein, 6 aa, synthetic construct
QDIYQN

SEQ ID NO: 2264 - protein, 6 aa, synthetic construct
QPIGPD

SEQ ID NO: 2265 - protein, 6 aa, synthetic construct
QSIRRY

SEQ ID NO: 2266 - protein, 6 aa, synthetic construct
QDVSSG

SEQ ID NO: 2267 - protein, 6 aa, synthetic construct
QRISRY

SEQ ID NO: 2268 - protein, 6 aa, synthetic construct
QTIGDY

SEQ ID NO: 2269 - protein, 6 aa, synthetic construct
QTIERR

SEQ ID NO: 2270 - protein, 6 aa, synthetic construct
QSIRRY

SEQ ID NO: 2271 - protein, 6 aa, synthetic construct
QTIERR

SEQ ID NO: 2272 - protein, 6 aa, synthetic construct
QNIRSY

SEQ ID NO: 2273 - protein, 6 aa, synthetic construct
QDINKY

SEQ ID NO: 2274 - protein, 7 aa, synthetic construct
DRLGEKY

SEQ ID NO: 2275 - protein, 6 aa, synthetic construct
QSISSY

SEQ ID NO: 2276 - protein, 6 aa, synthetic construct
QTIGDY

SEQ ID NO: 2277 - protein, 6 aa, synthetic construct
QDIKNY

SEQ ID NO: 2278 - protein, 6 aa, synthetic construct
QNIRSY

SEQ ID NO: 2279 - protein, 7 aa, synthetic construct
DNLRSYY

SEQ ID NO: 2280 - protein, 6 aa, synthetic construct
KLAEKY

SEQ ID NO: 2281 - protein, 5 aa, synthetic construct
SSVSY

SEQ ID NO: 2282 - protein, 6 aa, synthetic construct
QSISSY

SEQ ID NO: 2283 - protein, 6 aa, synthetic construct
QSIRRY

SEQ ID NO: 2284 - protein, 6 aa, synthetic construct
QTIERR

SEQ ID NO: 2285 - skipped

SEQ ID NO: 2286 - protein, 6 aa, synthetic construct
QDISNY

SEQ ID NO: 2287 - protein, 6 aa, synthetic construct
QDIYQN

SEQ ID NO: 2288 - protein, 6 aa, synthetic construct
QSISSY

SEQ ID NO: 2289 - protein, 6 aa, synthetic construct
QSIRRY

SEQ ID NO: 2290 - protein, 12 aa, synthetic construct
QSLFNVRSQKNY

SEQ ID NO: 2291 - protein, 6 aa, synthetic construct
QSIRRY

SEQ ID NO: 2292 - protein, 6 aa, synthetic construct
KLAEKY

SEQ ID NO: 2293 - protein, 6 aa, synthetic construct
QDINKY

SEQ ID NO: 2294 - protein, 6 aa, synthetic construct
QPIAYF

SEQ ID NO: 2295 - protein, 6 aa, synthetic construct
DHIGKF

SEQ ID NO: 2296 - protein, 6 aa, synthetic construct
QSISSY

SEQ ID NO: 2297 - protein, 6 aa, synthetic construct
QSIRRY

SEQ ID NO: 2298 - protein, 6 aa, synthetic construct
QSISSY

SEQ ID NO: 2299 - protein, 6 aa, synthetic construct
QDIKNY

SEQ ID NO: 2300 - protein, 6 aa, synthetic construct
QYIGTA

SEQ ID NO: 2301 - protein, 6 aa, synthetic construct
QSISGY

SEQ ID NO: 2302 - protein, 6 aa, synthetic construct
QSIGRY

SEQ ID NO: 2303 - protein, 6 aa, synthetic construct
QDIYQN

SEQ ID NO: 2304 - protein, 6 aa, synthetic construct
QPIGPD

SEQ ID NO: 2305 - protein, 6 aa, synthetic construct
QPIGPD

SEQ ID NO: 2306 - protein, 6 aa, synthetic construct
QDINKY

SEQ ID NO: 2307 - protein, 6 aa, synthetic construct
QRISSF

SEQ ID NO: 2308 - protein, 6 aa, synthetic construct
QNIATY

SEQ ID NO: 2309 - protein, 7 aa, synthetic construct
GDLRNKY

SEQ ID NO: 2310 - protein, 6 aa, synthetic construct
QPIGPD

SEQ ID NO: 2311 - protein, 6 aa, synthetic construct
QSIYSF

SEQ ID NO: 2312 - protein, 6 aa, synthetic construct
QDINKY

SEQ ID NO: 2313 - protein, 6 aa, synthetic construct
DHIGKF

SEQ ID NO: 2314 - protein, 6 aa, synthetic construct
HNINSY

SEQ ID NO: 2315 - protein, 6 aa, synthetic construct
QDINKY

SEQ ID NO: 2316 - protein, 6 aa, synthetic construct
QDISNY

SEQ ID NO: 2317 - protein, 6 aa, synthetic construct
QNIGNF

SEQ ID NO: 2318 - protein, 5 aa, synthetic construct
SSVTY

SEQ ID NO: 2319 - protein, 6 aa, synthetic construct
QDIYQN

SEQ ID NO: 2320 - protein, 6 aa, synthetic construct
QDIGNY

SEQ ID NO: 2321 - protein, 6 aa, synthetic construct
QPIAYF

SEQ ID NO: 2322 - protein, 7 aa, synthetic construct
DNLRGYY

SEQ ID NO: 2323 - protein, 10 aa, synthetic construct
QLVHSTGNTY

SEQ ID NO: 2324 - protein, 6 aa, synthetic construct
SLRNYY

SEQ ID NO: 2325 - protein, 6 aa, synthetic construct
QDIKNY

SEQ ID NO: 2326 - protein, 6 aa, synthetic construct
QDVSSG

SEQ ID NO: 2327 - protein, 6 aa, synthetic construct
QGVRTS

SEQ ID NO: 2328 - protein, 6 aa, synthetic construct
QDINKY

SEQ ID NO: 2329 - protein, 6 aa, synthetic construct
KLAEKN

SEQ ID NO: 2330 - protein, 6 aa, synthetic construct
QTIGDY

SEQ ID NO: 2331 - protein, 6 aa, synthetic construct
QSISSY

SEQ ID NO: 2332 - protein, 6 aa, synthetic construct
QSLSSY

SEQ ID NO: 2333 - protein, 6 aa, synthetic construct
QDINKY

SEQ ID NO: 2334 - protein, 6 aa, synthetic construct
QDVSSG

SEQ ID NO: 2335 - protein, 6 aa, synthetic construct
QTIERR

SEQ ID NO: 2336 - protein, 6 aa, synthetic construct
QDINKY

SEQ ID NO: 2337 - protein, 6 aa, synthetic construct
QSIRSF

SEQ ID NO: 2338 - protein, 6 aa, synthetic construct
QDIYQN

SEQ ID NO: 2339 - protein, 6 aa, synthetic construct
QSLSSY

SEQ ID NO: 2340 - protein, 7 aa, synthetic construct
GDLRNKY

SEQ ID NO: 2341 - protein, 6 aa, synthetic construct
QSVDRY

SEQ ID NO: 2342 - protein, 6 aa, synthetic construct
QFIGRY

SEQ ID NO: 2343 - protein, 6 aa, synthetic construct
QPIGPD

SEQ ID NO: 2344 - protein, 6 aa, synthetic construct
QTIGDY

SEQ ID NO: 2345 - protein, 6 aa, synthetic construct
QTIERR

SEQ ID NO: 2346 - protein, 6 aa, synthetic construct
QSIRRF

SEQ ID NO: 2347 - protein, 6 aa, synthetic construct
QDIYQN

SEQ ID NO: 2348 - protein, 6 aa, synthetic construct
QNIATY

SEQ ID NO: 2349 - protein, 6 aa, synthetic construct
QDINKY

SEQ ID NO: 2350 - protein, 6 aa, synthetic construct
QNIGNF

SEQ ID NO: 2351 - protein, 6 aa, synthetic construct
QTIERR

SEQ ID NO: 2352 - protein, 6 aa, synthetic construct
QRISSF

SEQ ID NO: 2353 - protein, 6 aa, synthetic construct
QSISSY

SEQ ID NO: 2354 - protein, 7 aa, synthetic construct
DKLGDKY

SEQ ID NO: 2355 - protein, 6 aa, synthetic construct
QDIYQN

SEQ ID NO: 2356 - protein, 6 aa, synthetic construct
QSISSY

SEQ ID NO: 2357 - protein, 6 aa, synthetic construct
QSISGY

SEQ ID NO: 2358 - protein, 6 aa, synthetic construct
QDINKY

SEQ ID NO: 2359 - protein, 6 aa, synthetic construct
QNIRSY

SEQ ID NO: 2360 - protein, 6 aa, synthetic construct
QSIREY

SEQ ID NO: 2361 - protein, 7 aa, synthetic construct
GDLGEKY

SEQ ID NO: 2362 - protein, 6 aa, synthetic construct
QNIATY

SEQ ID NO: 2363 - protein, 9 aa, synthetic construct
KVSTSGYVY

SEQ ID NO: 2364 - protein, 5 aa, synthetic construct
SSVSY

SEQ ID NO: 2365 - protein, 6 aa, synthetic construct
QDVSSG

SEQ ID NO: 2366 - protein, 6 aa, synthetic construct
QSVDRY

SEQ ID NO: 2367 - protein, 8 aa, synthetic construct
QSVYSNNE

SEQ ID NO: 2368 - protein, 6 aa, synthetic construct
QSISTY

SEQ ID NO: 2369 - protein, 6 aa, synthetic construct
HSISSY

SEQ ID NO: 2370 - protein, 6 aa, synthetic construct
QSIHSY

SEQ ID NO: 2371 - protein, 6 aa, synthetic construct
QSVSRF

SEQ ID NO: 2372 - protein, 6 aa, synthetic construct
QSIGTY

SEQ ID NO: 2373 - protein, 6 aa, synthetic construct
QSIGIH

SEQ ID NO: 2374 - protein, 6 aa, synthetic construct
QSIRSY

SEQ ID NO: 2375 - protein, 6 aa, synthetic construct
QGIATY

SEQ ID NO: 2376 - protein, 6 aa, synthetic construct
QSIGSY

SEQ ID NO: 2377 - protein, 6 aa, synthetic construct
QSISRN

SEQ ID NO: 2378 - protein, 6 aa, synthetic construct
QSVRTY

SEQ ID NO: 2379 - protein, 6 aa, synthetic construct
QSIGSH

SEQ ID NO: 2380 - protein, 6 aa, synthetic construct
QSISRY

SEQ ID NO: 2381 - protein, 6 aa, synthetic construct
QNIGNY

SEQ ID NO: 2382 - protein, 6 aa, synthetic construct
QSISTY

SEQ ID NO: 2383 - protein, 6 aa, synthetic construct
QNIGSY

SEQ ID NO: 2384 - protein, 6 aa, synthetic construct
QSISRF

SEQ ID NO: 2385 - protein, 6 aa, synthetic construct
ESITTY

SEQ ID NO: 2386 - protein, 6 aa, synthetic construct
QSISTY

SEQ ID NO: 2387 - protein, 6 aa, synthetic construct
QSIGSN

SEQ ID NO: 2388 - protein, 6 aa, synthetic construct
QSISRY

SEQ ID NO: 2389 - protein, 6 aa, synthetic construct
QYIGTY

SEQ ID NO: 2390 - protein, 6 aa, synthetic construct
ESISRN

SEQ ID NO: 2391 - protein, 6 aa, synthetic construct
QSISTY

SEQ ID NO: 2392 - protein, 6 aa, synthetic construct
QSVSNF

SEQ ID NO: 2393 - protein, 6 aa, synthetic construct
RNIRTY

SEQ ID NO: 2394 - protein, 6 aa, synthetic construct
QSIGNF

SEQ ID NO: 2395 - protein, 6 aa, synthetic construct
QSIRSY

SEQ ID NO: 2396 - protein, 6 aa, synthetic construct
QSIRTY

SEQ ID NO: 2397 - protein, 6 aa, synthetic construct
QNIYTY

SEQ ID NO: 2398 - protein, 6 aa, synthetic construct
QSISRY

SEQ ID NO: 2399 - protein, 6 aa, synthetic construct
QNIGRY

SEQ ID NO: 2400 - protein, 6 aa, synthetic construct
QTISAY

SEQ ID NO: 2401 - protein, 6 aa, synthetic construct
QSIRGY

SEQ ID NO: 2402 - protein, 6 aa, synthetic construct
QSVSYY

SEQ ID NO: 2403 - protein, 6 aa, synthetic construct
QPISSY

SEQ ID NO: 2404 - protein, 6 aa, synthetic construct
QSIGKY

SEQ ID NO: 2405 - protein, 6 aa, synthetic construct
QSIGAY

SEQ ID NO: 2406 - protein, 6 aa, synthetic construct
QTISTF

SEQ ID NO: 2407 - protein, 6 aa, synthetic construct
QSIGRY

SEQ ID NO: 2408 - protein, 6 aa, synthetic construct
QSISNY

SEQ ID NO: 2409 - protein, 6 aa, synthetic construct
QTISRS

SEQ ID NO: 2410 - protein, 6 aa, synthetic construct
QSISSY

SEQ ID NO: 2411 - protein, 6 aa, synthetic construct
RSIGTY

SEQ ID NO: 2412 - protein, 6 aa, synthetic construct
QNINRY

SEQ ID NO: 2413 - protein, 6 aa, synthetic construct
QSVSSY

SEQ ID NO: 2414 - protein, 6 aa, synthetic construct
QSIGIH

SEQ ID NO: 2415 - protein, 6 aa, synthetic construct
RSISTY

SEQ ID NO: 2416 - protein, 6 aa, synthetic construct
QSISRY

SEQ ID NO: 2417 - protein, 6 aa, synthetic construct
QSISNF

SEQ ID NO: 2418 - protein, 6 aa, synthetic construct
QGISFY

SEQ ID NO: 2419 - protein, 6 aa, synthetic construct
QNIKTY

SEQ ID NO: 2420 - protein, 6 aa, synthetic construct
QYISNY

SEQ ID NO: 2421 - protein, 6 aa, synthetic construct
QTISTF

SEQ ID NO: 2422 - protein, 6 aa, synthetic construct
QSISRF

SEQ ID NO: 2423 - protein, 6 aa, synthetic construct
ESIDNY

SEQ ID NO: 2424 - protein, 6 aa, synthetic construct
QSISNF

SEQ ID NO: 2425 - protein, 6 aa, synthetic construct
QSIGTN

SEQ ID NO: 2426 - protein, 6 aa, synthetic construct
QTITRY

SEQ ID NO: 2427 - protein, 6 aa, synthetic construct
QSIGNF

SEQ ID NO: 2428 - protein, 6 aa, synthetic construct
HSISRY

SEQ ID NO: 2429 - protein, 6 aa, synthetic construct
QGISFY

SEQ ID NO: 2430 - protein, 6 aa, synthetic construct
QSVSNY

SEQ ID NO: 2431 - protein, 6 aa, synthetic construct
QSIGSF

SEQ ID NO: 2432 - protein, 6 aa, synthetic construct
QSITRH

SEQ ID NO: 2433 - protein, 6 aa, synthetic construct
QRISRY

SEQ ID NO: 2434 - protein, 6 aa, synthetic construct
QYIGNY

SEQ ID NO: 2435 - protein, 6 aa, synthetic construct
QYISTF

SEQ ID NO: 2436 - protein, 6 aa, synthetic construct
RSISRY

SEQ ID NO: 2437 - protein, 6 aa, synthetic construct
QSISRS

SEQ ID NO: 2438 - protein, 6 aa, synthetic construct
QSITSY

SEQ ID NO: 2439 - protein, 6 aa, synthetic construct
QNIAGY

SEQ ID NO: 2440 - protein, 6 aa, synthetic construct
QTIRTY

SEQ ID NO: 2441 - protein, 6 aa, synthetic construct
QSIGIH

SEQ ID NO: 2442 - protein, 6 aa, synthetic construct
QSISTY

SEQ ID NO: 2443 - protein, 6 aa, synthetic construct
QSIGRY

SEQ ID NO: 2444 - protein, 6 aa, synthetic construct
HTISRY

SEQ ID NO: 2445 - protein, 6 aa, synthetic construct
QSISRY

SEQ ID NO: 2446 - protein, 6 aa, synthetic construct
QRINTY

SEQ ID NO: 2447 - protein, 6 aa, synthetic construct
QSINHY

SEQ ID NO: 2448 - protein, 6 aa, synthetic construct
QTIGRY

SEQ ID NO: 2449 - protein, 6 aa, synthetic construct
QSIGEY

SEQ ID NO: 2450 - protein, 6 aa, synthetic construct
QSIYRY

SEQ ID NO: 2451 - protein, 6 aa, synthetic construct
QNIGRY

SEQ ID NO: 2452 - protein, 6 aa, synthetic construct
QSIRNY

SEQ ID NO: 2453 - protein, 6 aa, synthetic construct
QSISRH

SEQ ID NO: 2454 - protein, 6 aa, synthetic construct
QSISRY

SEQ ID NO: 2455 - protein, 6 aa, synthetic construct
QSIGTY

SEQ ID NO: 2456 - protein, 6 aa, synthetic construct
QGIATY

SEQ ID NO: 2457 - protein, 6 aa, synthetic construct
QNIGGY

SEQ ID NO: 2458 - protein, 6 aa, synthetic construct
QYIGNY

SEQ ID NO: 2459 - protein, 6 aa, synthetic construct
QSIGTY

SEQ ID NO: 2460 - protein, 6 aa, synthetic construct
QNIGRY

SEQ ID NO: 2461 - protein, 6 aa, synthetic construct
QSISRH

SEQ ID NO: 2462 - protein, 6 aa, synthetic construct
QSIHNY

SEQ ID NO: 2463 - protein, 6 aa, synthetic construct
QGIATY

SEQ ID NO: 2464 - protein, 6 aa, synthetic construct
QTITKY

SEQ ID NO: 2465-2521 - skipped (57 entries)

SEQ ID NO: 2522 - protein, 10 aa, synthetic construct
QSYDDHDRIV

SEQ ID NO: 2523 - protein, 8 aa, synthetic construct
QQSYSTPT

SEQ ID NO: 2524 - protein, 9 aa, synthetic construct
QQSYSSPLT

SEQ ID NO: 2525 - protein, 9 aa, synthetic construct
QQYYNLPWT

SEQ ID NO: 2526 - protein, 10 aa, synthetic construct
ASRDRSGHGV

SEQ ID NO: 2527 - protein, 9 aa, synthetic construct
QQSYNTPLT

SEQ ID NO: 2528 - protein, 9 aa, synthetic construct
QHSYRSGRA

SEQ ID NO: 2529 - protein, 8 aa, synthetic construct
KQSYTLRT

SEQ ID NO: 2530 - protein, 9 aa, synthetic construct
QQSYSPPLT

SEQ ID NO: 2531 - protein, 9 aa, synthetic construct
GQDYTSPRT

SEQ ID NO: 2532 - protein, 5 aa, synthetic construct
QQSRT

SEQ ID NO: 2533 - protein, 8 aa, synthetic construct
QQSYSTPS

SEQ ID NO: 2534 - protein, 11 aa, synthetic construct
SSWAGSRSGTV

SEQ ID NO: 2535 - protein, 12 aa, synthetic construct
NSRDTSINHPVI

SEQ ID NO: 2536 - protein, 8 aa, synthetic construct
QQSYSTPT

SEQ ID NO: 2537 - protein, 11 aa, synthetic construct
LAWDTRTSGAV

SEQ ID NO: 2538 - protein, 11 aa, synthetic construct
QSYGSHSNFVV

SEQ ID NO: 2539 - protein, 10 aa, synthetic construct
QSYDLRYSHV

SEQ ID NO: 2540 - protein, 12 aa, synthetic construct
ASRSSKGNPHVL

SEQ ID NO: 2541 - protein, 9 aa, synthetic construct
QQRARHPHT

SEQ ID NO: 2542 - protein, 10 aa, synthetic construct
QSYDDHDRIV

SEQ ID NO: 2543 - protein, 11 aa, synthetic construct
LAWDTRTSGAV

SEQ ID NO: 2544 - protein, 9 aa, synthetic construct
QQGKTLPLT

SEQ ID NO: 2545 - protein, 9 aa, synthetic construct
QQSTILPLT

SEQ ID NO: 2546 - protein, 9 aa, synthetic construct
QQRARHPHT

SEQ ID NO: 2547 - protein, 9 aa, synthetic construct
QQGSSLPLT

SEQ ID NO: 2548 - protein, 11 aa, synthetic construct
NSRDTSGNHRV

SEQ ID NO: 2549 - protein, 11 aa, synthetic construct
NSRDTSGNHLV

SEQ ID NO: 2550 - protein, 8 aa, synthetic construct
QQTYSTRT

SEQ ID NO: 2551 - protein, 9 aa, synthetic construct
QAWGSSTVI

SEQ ID NO: 2552 - protein, 9 aa, synthetic construct
QQRARHPHT

SEQ ID NO: 2553 - protein, 12 aa, synthetic construct
SSRDNSDNHLVV

SEQ ID NO: 2554 - protein, 9 aa, synthetic construct
QQSYSAPLT

SEQ ID NO: 2555 - protein, 9 aa, synthetic construct
QVWDTGTVV

SEQ ID NO: 2556 - protein, 8 aa, synthetic construct
QQSYSTPT

SEQ ID NO: 2557 - protein, 12 aa, synthetic construct
ASRSSKGNPHVL

SEQ ID NO: 2558 - protein, 9 aa, synthetic construct
QQSYETPLT

SEQ ID NO: 2559 - protein, 9 aa, synthetic construct
QQSTIMPLT

SEQ ID NO: 2560 - protein, 8 aa, synthetic construct
QQSYSTPT

SEQ ID NO: 2561 - protein, 9 aa, synthetic construct
QQRDTTPWT

SEQ ID NO: 2562 - protein, 10 aa, synthetic construct
QARDRNTYVA

SEQ ID NO: 2563 - protein, 11 aa, synthetic construct
NSRDTSGLHYV

SEQ ID NO: 2564 - protein, 9 aa, synthetic construct
QQYDAYPPT

SEQ ID NO: 2565 - protein, 9 aa, synthetic construct
QQSYSAPLT

SEQ ID NO: 2566 - protein, 9 aa, synthetic construct
LQYASSPFT

SEQ ID NO: 2567 - protein, 8 aa, synthetic construct
QQSFSVPA

SEQ ID NO: 2568 - protein, 9 aa, synthetic construct
QQSYNTPLT

SEQ ID NO: 2569 - protein, 8 aa, synthetic construct
QQSYSTPT

SEQ ID NO: 2570 - protein, 9 aa, synthetic construct
SQSTRVPPT

SEQ ID NO: 2571 - protein, 11 aa, synthetic construct
SSWAGSRSGTV

SEQ ID NO: 2572 - protein, 9 aa, synthetic construct
SSGSRSGTV

SEQ ID NO: 2573 - protein, 9 aa, synthetic construct
QQSYSAPYT

SEQ ID NO: 2574 - protein, 9 aa, synthetic construct
QQTATWPFT

SEQ ID NO: 2575 - protein, 8 aa, synthetic construct
QQSYSTPT

SEQ ID NO: 2576 - protein, 9 aa, synthetic construct
QQSYKYPLT

SEQ ID NO: 2577 - protein, 9 aa, synthetic construct
QQSYSSPLT

SEQ ID NO: 2578 - protein, 8 aa, synthetic construct
QQSYSTPT

SEQ ID NO: 2579 - protein, 9 aa, synthetic construct
QQGYTLPWT

SEQ ID NO: 2580 - protein, 9 aa, synthetic construct
QQSYSAPLT

SEQ ID NO: 2581 - protein, 9 aa, synthetic construct
QQSYDNPLT

SEQ ID NO: 2582 - protein, 9 aa, synthetic construct
LQFDHTPFT

SEQ ID NO: 2583 - protein, 9 aa, synthetic construct
QQGYRFPLT

SEQ ID NO: 2584 - protein, 12 aa, synthetic construct
ASRSSKGNPHVL

SEQ ID NO: 2585 - protein, 8 aa, synthetic construct
QQSYSPLT

SEQ ID NO: 2586 - protein, 8 aa, synthetic construct
SQSTHVPT

SEQ ID NO: 2587 - protein, 12 aa, synthetic construct
STRSRKGNPHVL

SEQ ID NO: 2588 - protein, 9 aa, synthetic construct
QQSYSPPLT

SEQ ID NO: 2589 - protein, 9 aa, synthetic construct
HQRSSYPWT

SEQ ID NO: 2590 - protein, 9 aa, synthetic construct
QAWDNSAVI

SEQ ID NO: 2591 - protein, 8 aa, synthetic construct
QQSYSTPT

SEQ ID NO: 2592 - protein, 9 aa, synthetic construct
QQTYSTPLT

SEQ ID NO: 2593 - protein, 9 aa, synthetic construct
QQSNSWPYT

SEQ ID NO: 2594 - protein, 9 aa, synthetic construct
AQTGTHPTT

SEQ ID NO: 2595 - protein, 14 aa, synthetic construct
HTWHHNPHTGETNH

SEQ ID NO: 2596 - protein, 8 aa, synthetic construct
QQSYSTPT

SEQ ID NO: 2597 - protein, 11 aa, synthetic construct
NSRDTSGLHYV

SEQ ID NO: 2598 - protein, 9 aa, synthetic construct
QQTYSPPLT

SEQ ID NO: 2599 - protein, 9 aa, synthetic construct
QQSYSSPLT

SEQ ID NO: 2600 - protein, 9 aa, synthetic construct
QQYYDWPLT

SEQ ID NO: 2601 - protein, 8 aa, synthetic construct
QQYYSGWT

SEQ ID NO: 2602 - protein, 9 aa, synthetic construct
QNVLSTPYT

SEQ ID NO: 2603 - protein, 9 aa, synthetic construct
QAWVSSTVV

SEQ ID NO: 2604 - protein, 9 aa, synthetic construct
SQSTHVPLT

SEQ ID NO: 2605 - protein, 8 aa, synthetic construct
QQSYSTPT

SEQ ID NO: 2606 - protein, 9 aa, synthetic construct
QQSYSTPRT

SEQ ID NO: 2607 - protein, 8 aa, synthetic construct
SQSTHVPT

SEQ ID NO: 2608 - protein, 9 aa, synthetic construct
QQYHSYPPT

SEQ ID NO: 2609 - protein, 8 aa, synthetic construct
QQSFSVPA

SEQ ID NO: 2610 - protein, 9 aa, synthetic construct
QQSYSAPLT

SEQ ID NO: 2611 - protein, 9 aa, synthetic construct
LQDYNYPLT

SEQ ID NO: 2612 - protein, 9 aa, synthetic construct
QQTYNVPPT

SEQ ID NO: 2613 - protein, 10 aa, synthetic construct
ASRDRSGHGV

SEQ ID NO: 2614 - protein, 11 aa, synthetic construct
SSRDRSGNHRV

SEQ ID NO: 2615 - protein, 8 aa, synthetic construct
QQSYSTPT

SEQ ID NO: 2616 - protein, 9 aa, synthetic construct
AQNLEIPRT

SEQ ID NO: 2617 - protein, 9 aa, synthetic construct
QPSFYFPYT

SEQ ID NO: 2618 - protein, 8 aa, synthetic construct
QQYYSGWT

SEQ ID NO: 2619 - protein, 9 aa, synthetic construct
QQYWAFPVT

SEQ ID NO: 2620 - protein, 9 aa, synthetic construct
QQSYSSPRT

SEQ ID NO: 2621 - protein, 9 aa, synthetic construct
QQSYSTPNT

SEQ ID NO: 2622 - protein, 8 aa, synthetic construct
LQDYNLWT

SEQ ID NO: 2623 - protein, 9 aa, synthetic construct
QAWDTSTAV

SEQ ID NO: 2624 - protein, 9 aa, synthetic construct
QAWASSTVV

SEQ ID NO: 2625 - protein, 12 aa, synthetic construct
STRSSKGNPHVL

SEQ ID NO: 2626 - protein, 9 aa, synthetic construct
QQYWAFPVT

SEQ ID NO: 2627 - protein, 9 aa, synthetic construct
QQSYSTPWT

SEQ ID NO: 2628 - protein, 9 aa, synthetic construct
QQYHSYPPT

SEQ ID NO: 2629 - protein, 9 aa, synthetic construct
QAWDNRAVV

SEQ ID NO: 2630 - protein, 8 aa, synthetic construct
QQSYSTPT

SEQ ID NO: 2631 - protein, 9 aa, synthetic construct
QQNYIIPWT

SEQ ID NO: 2632 - protein, 9 aa, synthetic construct
QQNYNTPFT

SEQ ID NO: 2633 - protein, 9 aa, synthetic construct
QQSFSSPLT

SEQ ID NO: 2634 - protein, 9 aa, synthetic construct
QQSYDTPFT

SEQ ID NO: 2635 - protein, 9 aa, synthetic construct
QQNYNTPLT

SEQ ID NO: 2636 - protein, 10 aa, synthetic construct
QQSYNTPPYT

SEQ ID NO: 2637 - protein, 9 aa, synthetic construct
QQGYTSPLT

SEQ ID NO: 2638 - protein, 10 aa, synthetic construct
QQTFTNTPLT

SEQ ID NO: 2639 - protein, 9 aa, synthetic construct
QQSHNIPRT

SEQ ID NO: 2640 - protein, 9 aa, synthetic construct
QQGYITPQT

SEQ ID NO: 2641 - protein, 9 aa, synthetic construct
QQSFTTPLT

SEQ ID NO: 2642 - protein, 9 aa, synthetic construct
QQSYSPPIT

SEQ ID NO: 2643 - protein, 9 aa, synthetic construct
QQSSSVPWT

SEQ ID NO: 2644 - protein, 9 aa, synthetic construct
QQNYNTPLT

SEQ ID NO: 2645 - protein, 9 aa, synthetic construct
QQSYTPPIT

SEQ ID NO: 2646 - protein, 9 aa, synthetic construct
QQSYNTPVT

SEQ ID NO: 2647 - protein, 9 aa, synthetic construct
QQSYIPPLT

SEQ ID NO: 2648 - protein, 9 aa, synthetic construct
QQNYITPLT

SEQ ID NO: 2649 - protein, 8 aa, synthetic construct
QQSYNSIT

SEQ ID NO: 2650 - protein, 9 aa, synthetic construct
QQSYRIPRT

SEQ ID NO: 2651 - protein, 9 aa, synthetic construct
QQSYSTPTT

SEQ ID NO: 2652 - protein, 8 aa, synthetic construct
QQSYSDLT

SEQ ID NO: 2653 - protein, 10 aa, synthetic construct
QQSYSGPPYT

SEQ ID NO: 2654 - protein, 9 aa, synthetic construct
QQNYIIPWT

SEQ ID NO: 2655 - protein, 9 aa, synthetic construct
QQSYSFPFS

SEQ ID NO: 2656 - protein, 9 aa, synthetic construct
QQSYKTPVT

SEQ ID NO: 2657 - protein, 9 aa, synthetic construct
QQSYNTPIT

SEQ ID NO: 2658 - protein, 10 aa, synthetic construct
QQSYSTLPFT

SEQ ID NO: 2659 - protein, 5 aa, synthetic construct
QQRDT

SEQ ID NO: 2660 - protein, 9 aa, synthetic construct
QQSYSTRFT

SEQ ID NO: 2661 - protein, 8 aa, synthetic construct
QQSYSSPT

SEQ ID NO: 2662 - protein, 9 aa, synthetic construct
QQTYSPPLT

SEQ ID NO: 2663 - protein, 8 aa, synthetic construct
QQSYSGLT

SEQ ID NO: 2664 - protein, 9 aa, synthetic construct
QQNYNTPLT

SEQ ID NO: 2665 - protein, 9 aa, synthetic construct
QQTYSSPVT

SEQ ID NO: 2666 - protein, 9 aa, synthetic construct
QQGYSAPLT

SEQ ID NO: 2667 - protein, 9 aa, synthetic construct
QQTYSTPLT

SEQ ID NO: 2668 - protein, 9 aa, synthetic construct
QQSYGTLIT

SEQ ID NO: 2669 - protein, 9 aa, synthetic construct
QQSYSTPLT

SEQ ID NO: 2670 - protein, 8 aa, synthetic construct
QQSYSTPS

SEQ ID NO: 2671 - protein, 9 aa, synthetic construct
QQSYSLPLT

SEQ ID NO: 2672 - protein, 9 aa, synthetic construct
QQSFTTPYT

SEQ ID NO: 2673 - protein, 9 aa, synthetic construct
QQNYRSPLT

SEQ ID NO: 2674 - protein, 9 aa, synthetic construct
QQNYITPLT

SEQ ID NO: 2675 - protein, 9 aa, synthetic construct
QQSYSSPIT

SEQ ID NO: 2676 - protein, 9 aa, synthetic construct
HQTYSTPRT

SEQ ID NO: 2677 - protein, 10 aa, synthetic construct
QQSYNTPPYT

SEQ ID NO: 2678 - protein, 9 aa, synthetic construct
QQNYITPLT

SEQ ID NO: 2679 - protein, 9 aa, synthetic construct
QQGYSSPLT

SEQ ID NO: 2680 - protein, 9 aa, synthetic construct
QQSYSIPFT

SEQ ID NO: 2681 - protein, 10 aa, synthetic construct
QQSYSTPQIT

SEQ ID NO: 2682 - protein, 9 aa, synthetic construct
LQTYSVPLT

SEQ ID NO: 2683 - protein, 9 aa, synthetic construct
QQTYSLPLT

SEQ ID NO: 2684 - protein, 9 aa, synthetic construct
QQSYSTPLT

SEQ ID NO: 2685 - protein, 9 aa, synthetic construct
QQSYKTPRT

SEQ ID NO: 2686 - protein, 9 aa, synthetic construct
QQNYNIPFT

SEQ ID NO: 2687 - protein, 9 aa, synthetic construct
QQSYRVPRT

SEQ ID NO: 2688 - protein, 9 aa, synthetic construct
QQSYSIPLT

SEQ ID NO: 2689 - protein, 9 aa, synthetic construct
QQSYSTPET

SEQ ID NO: 2690 - protein, 9 aa, synthetic construct
QQSYSIPPT

SEQ ID NO: 2691 - protein, 8 aa, synthetic construct
QQSYSTHT

SEQ ID NO: 2692 - protein, 9 aa, synthetic construct
QQSYSPPLT

SEQ ID NO: 2693 - protein, 9 aa, synthetic construct
QQSYVTPPT

SEQ ID NO: 2694 - protein, 9 aa, synthetic construct
QQTYSPPFT

SEQ ID NO: 2695 - protein, 9 aa, synthetic construct
QQSYSTPGT

SEQ ID NO: 2696 - protein, 9 aa, synthetic construct
QQSYRTPIT

SEQ ID NO: 2697 - protein, 9 aa, synthetic construct
QQSFSAPYT

SEQ ID NO: 2698 - protein, 8 aa, synthetic construct
QQSYSPLT

SEQ ID NO: 2699 - protein, 9 aa, synthetic construct
QQSYTPPRT

SEQ ID NO: 2700 - protein, 9 aa, synthetic construct
QQSFTIPWT

SEQ ID NO: 2701 - protein, 9 aa, synthetic construct
QQSYNTPVT

SEQ ID NO: 2702 - protein, 9 aa, synthetic construct
QQSSSTPIT

SEQ ID NO: 2703 - protein, 9 aa, synthetic construct
QQSYRPPLT

SEQ ID NO: 2704 - protein, 10 aa, synthetic construct
QQSYNTPPYT

SEQ ID NO: 2705 - protein, 9 aa, synthetic construct
QQTYSAPRT

SEQ ID NO: 2706 - protein, 9 aa, synthetic construct
QQSYRTPLT

SEQ ID NO: 2707 - protein, 9 aa, synthetic construct
QQSFTAPDT

SEQ ID NO: 2708 - protein, 8 aa, synthetic construct
QQSYSDLT

SEQ ID NO: 2709 - protein, 9 aa, synthetic construct
QQSYRVPRT

SEQ ID NO: 2710 - protein, 9 aa, synthetic construct
QQSYSLPRT

SEQ ID NO: 2711 - protein, 9 aa, synthetic construct
QQTYSTPYT

SEQ ID NO: 2712 - protein, 9 aa, synthetic construct
QQNYRSPLT

SEQ ID NO: 2713 - protein, 9 aa, synthetic construct
QQSYSPPLT

SEQ ID NO: 2714 - protein, 9 aa, synthetic construct
QQSYRTPGT

SEQ ID NO: 2715 - protein, 9 aa, synthetic construct
QQSFLTPWT

SEQ ID NO: 2716 - protein, 9 aa, synthetic construct
QQSYSKPYT

SEQ ID NO: 2717 - protein, 9 aa, synthetic construct
QQSYSTPLS

SEQ ID NO: 2718 - protein, 9 aa, synthetic construct
QQSFTSPLT

SEQ ID NO: 2719 - protein, 9 aa, synthetic construct
QQTHSTPLT

SEQ ID NO: 2720 - protein, 10 aa, synthetic construct
QQSYSTPLLT

SEQ ID NO: 2721 - protein, 9 aa, synthetic construct
QQTSSTPLT

SEQ ID NO: 2722 - protein, 9 aa, synthetic construct
QQNYNTPLT

SEQ ID NO: 2723 - protein, 9 aa, synthetic construct
QQSYTPPRT

SEQ ID NO: 2724 - protein, 9 aa, synthetic construct
QQTYRTPLT

SEQ ID NO: 2725 - protein, 9 aa, synthetic construct
QQSYSTPYT

SEQ ID NO: 2726 - protein, 10 aa, synthetic construct
QQTFTNTPLT

SEQ ID NO: 2727 - protein, 9 aa, synthetic construct
QQSYSAPVT

What is claimed is:

1. An antibody or antibody fragment that binds to dickkopf-1 (DKK1) comprising a VHH domain, wherein the VHH domain comprises:
   a) a heavy chain CDR1 comprising the amino acid sequence of SEQ ID NO: 66, a heavy chain CDR2 comprising the amino acid sequence of SEQ ID NO: 164, and a heavy chain CDR3 comprising the amino acid sequence of SEQ ID NO: 262;
   b) a heavy chain CDR1 comprising the amino acid sequence of SEQ ID NO: 69, a heavy chain CDR2 comprising the amino acid sequence of SEQ ID NO: 167, and a heavy chain CDR3 comprising the amino acid sequence of SEQ ID NO: 265;
   c) a heavy chain CDR1 comprising the amino acid sequence of SEQ ID NO: 94, a heavy chain CDR2 comprising the amino acid sequence of SEQ ID NO: 192, and a heavy chain CDR3 comprising the amino acid sequence of SEQ ID NO: 290;
   d) a heavy chain CDR1 comprising the amino acid sequence of SEQ ID NO: 98, a heavy chain CDR2 comprising the amino acid sequence of SEQ ID NO: 196, and a heavy chain CDR3 comprising the amino acid sequence of SEQ ID NO: 294;
   e) a heavy chain CDR1 comprising the amino acid sequence of SEQ ID NO: 977, a heavy chain CDR2 comprising the amino acid sequence of SEQ ID NO: 1391, and a heavy chain CDR3 comprising the amino acid sequence of SEQ ID NO: 1805; or
   f) a heavy chain CDR1 comprising the amino acid sequence of SEQ ID NO: 1305, a heavy chain CDR2 comprising the amino acid sequence of SEQ ID NO: 1719, and a heavy chain CDR3 comprising the amino acid sequence of SEQ ID NO: 2133.

2. The antibody or antibody fragment of claim 1, wherein the VHH domain comprises an amino acid sequence at least about 90% identical to the amino acid sequence of SEQ ID NO: 360, 363, 388, 392, 452, or 2231.

3. The antibody or antibody fragment of claim 1, wherein the VHH domain comprises the amino acid sequence of SEQ ID NO: 360, 363, 388, 392, 452, or 2231.

4. The antibody or antibody fragment of claim 1, wherein the antibody or antibody fragment is a monoclonal antibody, a bi-specific antibody, a multispecific antibody, a grafted antibody, a humanized antibody, a synthetic antibody, a single-domain antibody, an intrabody, or an antigen-binding fragment thereof.

5. The antibody or antibody fragment of claim 1, wherein the antibody or antibody fragment is a single domain antibody.

6. The antibody or antibody fragment of claim 1, wherein the antibody or antibody fragment comprises a Fc region.

7. The antibody or antibody fragment of claim 6, wherein the Fc region is a IgG2 Fc region.

8. The antibody or antibody fragment of claim 1, wherein the antibody or antibody fragment comprises a $K_D$ of less than 50 nM.

9. A pharmaceutical composition, comprising the antibody or antibody fragment of claim 1.

10. An isolated nucleic acid that encodes the antibody or antibody fragment of claim 1.

11. A method of treating a disease or disorder, comprising administering to a subject in need thereof the antibody or antibody fragment of claim 1, wherein the disease or disorder is a cancer, an inflammatory disease or disorder, a metabolic disease or disorder, a cardiovascular disease or disorder, a respiratory disease or disorder, pain, a digestive disease or disorder, a reproductive disease or disorder, an endocrine disease or disorder, or a neurological disease or disorder.

12. The method of claim 11, wherein the cancer is a gastro-esophageal cancer, an endometrial cancer, an ovarian cancer, a prostate cancer, or a liver cancer.

13. The method of claim 11, wherein the metabolic disease or disorder or endocrine disease or disorder is weight gain, obesity, Type II diabetes, hypoglycemia, or hyperinsulinism.

14. A method of activating an immune cell, comprising contacting the immune cell with the antibody or antibody fragment of claim 1.

15. The method of claim 14, wherein the immune cell is a natural killer (NK) cell.

16. A method of increasing interferon-γ (IFNγ) expression in an immune cell, comprising contacting the immune cell with the antibody or antibody fragment of claim 1.

17. A method of increasing granulocyte macrophage colony-stimulating factor (GM-CSF) expression in an immune cell, comprising contacting the immune cell with the antibody or antibody fragment of claim 1.

18. An expression vector comprising the nucleic acid of claim 10.

19. An isolated cell comprising the nucleic acid of claim 10.

20. An isolated cell comprising the expression vector of claim 18.

* * * * *